United States Patent
Sklar et al.

(10) Patent No.: US 6,444,642 B1
(45) Date of Patent: *Sep. 3, 2002

(54) METHODS OF INCREASING MYOTUBE FORMATION OR SURVIVAL OR MUSCLE CELL MITOGENESIS, DIFFERENTIATION OR SURVIVAL USING A NEUREGULIN

(75) Inventors: Robert Sklar, Newton; Mark Marchionni, Arlington; David I. Gwynne, Beverly, all of MA (US)

(73) Assignee: CeNes Pharmaceuticals, Inc., Norwood, MA (US)

(*) Notice: Subject to any disclaimer, the term of this patent is extended or adjusted under 35 U.S.C. 154(b) by 0 days.

This patent is subject to a terminal disclaimer.

(21) Appl. No.: 08/467,602

(22) Filed: Jun. 6, 1995

Related U.S. Application Data

(60) Division of application No. 08/209,204, filed on Mar. 8, 1994, which is a continuation-in-part of application No. 08/059,022, filed on May 6, 1993, now abandoned, which is a continuation-in-part of application No. 08/036,555, filed on Mar. 24, 1993, now Pat. No. 5,530,109, which is a continuation-in-part of application No. 07/965,173, filed on Oct. 23, 1992, now abandoned, and a continuation-in-part of application No. 07/940,389, filed on Sep. 3, 1992, now abandoned, and a continuation-in-part of application No. 07/907,138, filed on Jun. 30, 1992, now abandoned, and a continuation-in-part of application No. 07/863,703, filed on Apr. 3, 1992, now abandoned.

(30) Foreign Application Priority Data

Apr. 10, 1991 (GB) .............................................. 9107566

(51) Int. Cl.$^7$ ................................................ A61K 38/18
(52) U.S. Cl. ............................ 514/8; 514/12; 530/350
(58) Field of Search ..................... 514/12, 8; 530/300, 530/350

(56) References Cited

U.S. PATENT DOCUMENTS

| | | | |
|---|---|---|---|
| 4,935,341 A | 6/1990 | Bargmann et al. ............. | 435/6 |
| 4,968,603 A | 11/1990 | Slamon et al. .................. | 435/6 |
| 5,367,060 A | 11/1994 | Vandlen et al. ............. | 530/399 |
| 5,602,096 A | * 2/1997 | Goodearl et al. ............. | 514/12 |

FOREIGN PATENT DOCUMENTS

| | | |
|---|---|---|
| WO | PCT/US89/00051 | 7/1989 |
| WO | PCT/US90/02697 | 11/1990 |
| WO | PCT/US91/02331 | 10/1991 |
| WO | PCT/US91/03443 | 12/1991 |
| WO | PCT/US92/00329 | 7/1992 |

OTHER PUBLICATIONS

Lemke et al., Glial growth factor: a mitogenic polypeptide of the brain and pituitary, Fed. Proc. 42: 2627–2629, 1983.*

Benveniste et al., "Purification and characterization of a human T–lymphocyte–derived glial growth–promoting factor", Proc. Nat'l. Acad. Sci. USA 82:3930–3934, 1985.

Berger et al., "Correlation of c–erbB–2 gene amplification and protein expression in human breast carcinoma with . . . " Cancer Research 48:1238–1243, 1988.

Brockes et al., "Purification and preliminary characterization of a glial growth factor from the bovine pituitary", J. Biol. Chem. 255:8374–8377, 1980.

Brockes et al., "The neuron as a source of mitogen", Development in the Nervous System, Garrod and Feldman, eds., pp. 309–327, 1980.

Chan et al., "Identification of a competative HGF antagonist encoded by an alternative transcript", Science 254:1382–1385, 1991.

Davis et al., "Platelet–derived growth factors and fibroblast growth factors are mitogens for rat schwaan cells", J. Cell. Biol. 110:1353–1360, 1990.

Davis et al., "Isolation and characterization of a new protein–specific activating factor from human ALT–2 cell conditioned medium", Biochem. Biophys. Res. Comm. 179:1536–1542, 1991.

Dobashi et al., "Characterization of a neu/c–erbB–2 protein–specific activating factor", Proc. Nat'l. Acad. Sci. USA 88:8582–8586, 1991.

Florini et al., "Effects of growth factors on myogenic differentiation", American J. of Physiology 256.

Holmes et al., "Identification of Heregulin, a specific activator of p185erbB2" Science 256:1205–1210, 1992.

Huang et al., "Purification and characterization of the neu/erb B2 ligand–growth factor from bovine kidney" J. Biol. Chem. 267:11508–11512, 1992.

Kimura et al., "Structure, expression and function of a schwannoma–derived growth factor" Nature 348:257–260, 1990.

Kraus et al., "Overexpression of the EGF receptor–related proto–oncogene erbB–2 in human mammary tumor cell lines by different molecular mechanisms", EMMBO J. 6:605–610, 1987.

Lemke et al., "Identification and purification of glial growth factor", J. Neuroscience 4:75–83, 1984.

Lemke et al., "An immunochemical approach to the purification and characterization of glial growth factor", Monoclonal Antibodies to Neural Antigens, McKay et al., eds. pp. 133–140, 1981.

Lupu et al., "Direct interaction of a ligand for the erbB2 oncogene product with the EGF receptor and p185 erb2", Science 249:1552–1555, 1990.

(List continued on next page.)

Primary Examiner—Lorraine Spector
Assistant Examiner—Claire M. Kaufman
(74) Attorney, Agent, or Firm—Clark & Elbing LLP; Kristina Bieker-Brady

(57) ABSTRACT

The invention relates to methods of treating diseases and disorders of the muscle tissues in a vertebrate by the administration of compounds which bind the p185$^{erbB2}$ receptor. These compounds are found to cause increased differentiation and survival of cardiac, skeletal and smooth muscle.

40 Claims, 71 Drawing Sheets

OTHER PUBLICATIONS

Lupu et al., "Characterization of a growth factor that binds exclusively to the erbB–2 receptor and induces cellular responses", Proc. Nat'l. Acad. Sci. USA 89:2287–2291, 1992.

Marchioni et al., "Glial growth factors are alternatively spliced erbB2 ligands expressed in the nervous system", Nature 362:312–362, 1993.

Peles et al., "Isolation of the new/HER–2 stimulatory ligand: . . . ", Cell 69:205–216, 1992.

Peles et al., "Neu and its ligands: From an oncogene to neural factors", Bioassays 15:815–824, 1993.

Perantoni et al., "Activated new oncogene sequences in primary tumors of the peripheral nervous system induced in rats . . . ", Proc. Nat'l. Acad. Sci. USA 84:6317–6321, 1987.

Slamon et al., "Human breast cancer: Correlation of relapse and survival with amplification of the HER–2/ neu oncogene", Science 235:177–182, 1987.

Slamon et al., "Studies of the HER–2/neu proto–oncogene in human breast and ovarian cancer", Science 244: 707–712, 1989.

Tarakhovsky et al., "A 25 kDa polypeptide is the ligand for p185neu and is secreted by activated macrophages", Oncogene 6:2187–2196, 1991.

Tsuda et al., "Correlation between long–term survival in breast cancer patients and amplification of two putative oncogene–coamplification units: . . . ", Cancer Research 49:3104–3108, 1989.

van de Vijver et al., "Amplification of the neu (c–erbB–2) oncogene in human mammary tumors is relatively frequent and is often . . . ", Mol. Cell. Biol. 7:2019–2023, 1987.

Varley et al., "Alterations to either c–erbB–2(neu) or c–myc proto–oncogenes in breast carcinomas correlate with poor short–term prognosis", Oncogene 1:423–430, 1987.

Venter et al., "Overexpression of the c–erbB–2 oncoprotein in human breast carcinomas: Immunohistological assessment correlates with gene amplification", II:69–72, 1987.

Wen et al., "Neu differentiation factor: A transmembrane clycoprotein containing an EGF domain and an immunoglobulin homology unit" Cell 69:559–572, 1992.

Yarden et al., "Biochemical analysis of the ligand for the neu oncogenic receptor" Biochemistry 30:3543–3550, 1991.

Yu et al., "Growth factor receptor tyrosine kinase", Ann. Rev. Biochem. 57:443–478, 1988.

Zhou et al., "Association of multiple copies of the c–erbB–2 oncogene with spread of breast cancer", Cancer Research 47:6123–6125, 1987.

Brockes et al., "Assay and isolation of glial growth factor from the bovine pituitary", Methods in Enzym. Jeong et al., Dialog Medline Abstract, J. Neurobiol. 22:462–74, 1991.

Jessel et al., "Induction of acetylcholine receptors on cultured skeletal muscle by a factor extracted from brain and spinal cord", Proc. Nat'l. Acad. Sci. USA 76:5397–5401, 1979.

Lentz et al., "Partial purification and characterization of a nerve trophic factor regulating muscle acetylcholinesterase activity", Exper. Neurology 73:542–557, 1981.

Markelonis et al., "Purification of sciatin using affinity chromatography on concanavalin in A–agarose", J. Neurochemistry 37:95–99, 1981.

Markelonis et al., Dialog Medline Abstract, J. Cell. Biol. 100:8–17, 1985.

Markelonis et al., Dialog Medline Abstract, J. Biol. Chem. 255:8967–70, 1980.

Markelonis et al., Dialog Medline Abstract, Exp. Neurol. 58:285–95, 1978.

Oh, "Neurotrophic effects of sciatic nerve extracts on muscle development in culture", Exp. Neurol. 50:376–386, 1976.

Oh et al., Dialog Medline Abstract, Dev. Biology 127:88–98, 1988.

Oh et al., Dialog Medline Abstract, J. Neuros. Res. 8:535–45, 1982.

Oh et al., Dialog Medline Abstract, Exp. Neurol. 67:646–54, 1980.

Oh et al., Dialog Medline Abstract, Science 200:337–9, 1978.

Oh et al., Dialog Medline Abstract, Exp. Neurol. 46:432–8, 1975.

Podleski et al., "Nerve extract induces increase and redistribution of acetylcholine receptors on cloned muscle cells", Proc. Nat'l. Acad. Sci. USA 75:2035–2039, 1978.

Thibault et al., "Trophic effect of a sciatic nerve extract on fast and slow myosin heavy chain synthesis", Am. Physiological Society 0363/6143; c269–C272, 1981.

Markelonis et al., Dialog Medline, J. Neurochem. 39:315–20, 1982.

Markelonis et al., Dialog Medline, Dev. Biol. 89:353–61, 1982.

Markelonis et al., Dialog Medline, J. Neurochem. 37:95–9, 1981.

Markelonis et al., Dialog Medline, Exp. Neurol. 70:598–612, 1980.

Oh et al., Dialog Medline, J. Histochem. Chytochem. 29:1205–12, 1981.

Oh et al., Dialog Medline, Proc. Nat'l. Acad. Sci. USA 77:6922–5, 1980.

Falls et al., "ARIA, a protein that stimulates acetylcholine receptor synthesis, is a member of the neu ligand family" Cell 72:810–815, 1993.

* cited by examiner

Duchenne Muscle Culture: Treatment

FIG. 8

```
GGF-I 01   N-terminus
           F K G D A H T E                              (SEQ ID NO: 1)

Trypsin peptides
GGF-I 02   K/R A S L A D E Y E Y M X K *               (SEQ ID NO: 2)    HMG-1
GGF-I 03   K/R T E T S S S G L X L K *                 (SEQ ID NO: 3)    HMG-1?
GGF-I 04   K/R K L G E M W A E                         (SEQ ID NO: 4)    HMG-2
GGF-I 05   K/R L G E K R A                             (SEQ ID NO: 5)
GGF-I 06   K/R I K S E H A G L S I G D T A K *         (SEQ ID NO: 6)
GGF-I 07   K/R A S L A D E Y E Y M R K *               (SEQ ID NO: 7)
GGF-I 08   K/R I K G E H P G L S I G D V A K *         (SEQ ID NO: 8)    HMG-1
GGF-I 09   K/R M S E Y A F F V Q T X R *               (SEQ ID NO: 9)    HMG-2
GGF-I 10   K/R S E H P G L S I G D T A K *             (SEQ ID NO: 10)   HMG-1
GGF-I 11   K/R A G Y F A E X A R *                     (SEQ ID NO: 11)
GGF-I 12   K/R K L E F L X A K *                       (SEQ ID NO: 12)
GGF-I 13   K/R T T E M A S E Q G A                     (SEQ ID NO: 13)
GGF-I 14   K/R A K E A L A A L K *                     (SEQ ID NO: 14)
GGF-I 15   K/R F V L Q A K K *                         (SEQ ID NO: 15)
GGF-I 16   K/R L G E M W                               (SEQ ID NO: 16)   HMG-1

Protease V8 peptides
GGF-I 17   E T Q P D P G Q I L K K V P M V I G A Y T   (SEQ ID NO: 29)
GGF-I 18   E Y K C L K F K W F K K K A T V M           (SEQ ID NO: 17)   LH-alpha
GGF-I 19   E A K Y F S K X D A                         (SEQ ID NO: 18)
GGF-I 20   E X K F Y V P                               (SEQ ID NO: 19)
GGF-I 21   E L S F A S V R L P G C P P G V D P M V S F P V A L   (SEQ ID NO: 20)   LH-beta
```

FIG. 9A

| | | | | | | | | | | |
|---|---|---|---|---|---|---|---|---|---|---|
| GGF-I 01 | F | K | G | D | A | H | T | E | | (SEQ ID NO: 1) |
| GGF-I 02 | A | S | L | A | D | E | Y | E | Y M X K | (SEQ ID NO: 22) |
| GGF-I 03 | T | E | T | S | S | G | L | X | L K | (SEQ ID NO: 23) |
| GGF-I 07 | A | S | L | A | D | E | Y | E | Y M R K | (SEQ ID NO: 24) |
| GGF-I 11 | A | G | Y | F | A | E | X | A | R | (SEQ ID NO: 25) |
| GGF-I 13 | T | T | E | M | A | S | E | Q | G A | (SEQ ID NO: 26) |
| GGF-I 14 | A | K | E | A | L | A | A | L | K | (SEQ ID NO: 27) |
| GGF-I 15 | F | V | L | Q | A | K | K | | | (SEQ ID NO: 28) |
| GGF-I 17 | E | T | Q | P | D | P | G | Q | I L K K V P M V I G A Y T | (SEQ ID NO: 29) |
| GGF-I 18 | E | Y | K | C | L | K | F | K | W F K K A T V M | (SEQ ID NO: 17) |

FIG. 9B

| | | | | | | | |
|---|---|---|---|---|---|---|---|
| GGF-I 20 | E | X | K | F | Y | V P | (SEQ ID NO: 19) |
| GGF-I 12 | K | L | E | F | L | X A K | (SEQ ID NO: 32) |

FIG. 10

Trypsin peptides

| | | | |
|---|---|---|---|
| GGF-II 01 | K/R V H Q V W A A K * | | (SEQ ID NO: 33) |
| GGF-II 02 | K/R Y I F F M E P E A X S S G | | (SEQ ID NO: 34) |
| GGF-II 03 | K/R L G A W G P P A F P V X Y | | (SEQ ID NO: 35) |
| GGF-II 04 | K/R W F V V I E G K * | | (SEQ ID NO: 36) |
| GGF-II 05 | K/R A L A A A G Y D V E K * | | (SEQ ID NO: 164) |
| GGF-II 06 | K/R L V L R * | | (SEQ ID NO: 165) |
| GGF-II 07 | K/R X X Y P G Q I T S N | Histone H1 | (SEQ ID NO: 166) |
| GGF-II 08 | K/R A S P V S V G S V Q E L V Q R * | Trypsin | (SEQ ID NO: 37) |
| GGF-II 09 | K/R V C L L T V A A L P P T | | (SEQ ID NO: 38) |
| GGF-II 10 | K/R D L L L X V | | (SEQ ID NO: 39) |

Lysyl Endopeptidase-C peptides

| | | |
|---|---|---|
| GGF-II 11 | K V H Q V W A A K * | (SEQ ID NO: 51) |
| GGF-II 12 | K A S L A D S G E Y M X K* | (SEQ ID NO: 52) |

| | | |
|---|---|---|
| GGF-II 01 | V H Q V W A A K | (SEQ ID NO: 45) |
| GGF-II 02 | Y I F F M E P E A X S S G | (SEQ ID NO: 46) |
| GGF-II 03 | L G A W G P P A F P V X Y | (SEQ ID NO: 47) |
| GGF-II 04 | W F V V I E G K | (SEQ ID NO: 48) |
| GGF-II 08 | A S P V S V G S V Q E L V Q R | (SEQ ID NO: 49) |
| GGF-II 09 | V C L L T V A A L P P T | (SEQ ID NO: 50) |
| GGF-II 11 | K V H Q V W A A K | (SEQ ID NO: 51) |
| GGF-II 12 | K A S L A D S G E Y M X K | (SEQ ID NO: 52) |

B     Novel Factor II Peptides - others

GGF-II 10    D L L X V                        (SEQ ID NO: 53)

Comparison of BrdU-ELISA and [125 I]UdR Counting Method for the DNA Synthesis Assay in Schwann Cell Cultures

Comparison of Br-UdR Immunoreactivity and Br-UdR Labelled Cell Number

Comparison of Br-UdR Immunoreactivity and Br-UdR Labelled Cell Number

Mitogenic Response of Rat Sciatic Nerve Schwann Cell to GGFs

DNA Synthesis in Rat Sciatic Nerve Schwann Cells and 3T3 Fibroblasts in the Presence of GGFs

Mitogenic Response of BHK21 C13 Cells to FCS and GGFs

Survival and Proliferation of BHK21 C13 Cell Microcultures After 48 Hours in Presence of GGFs

Mitogenic Response of C6 Cells to FCS

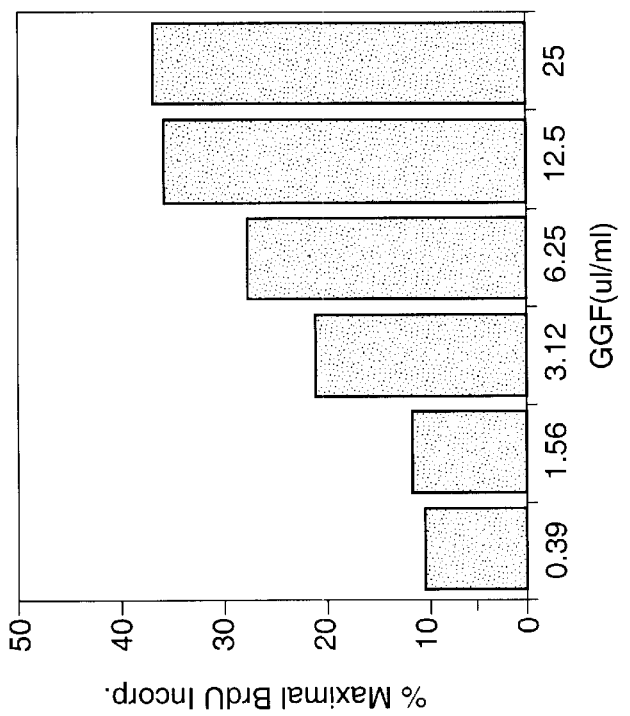
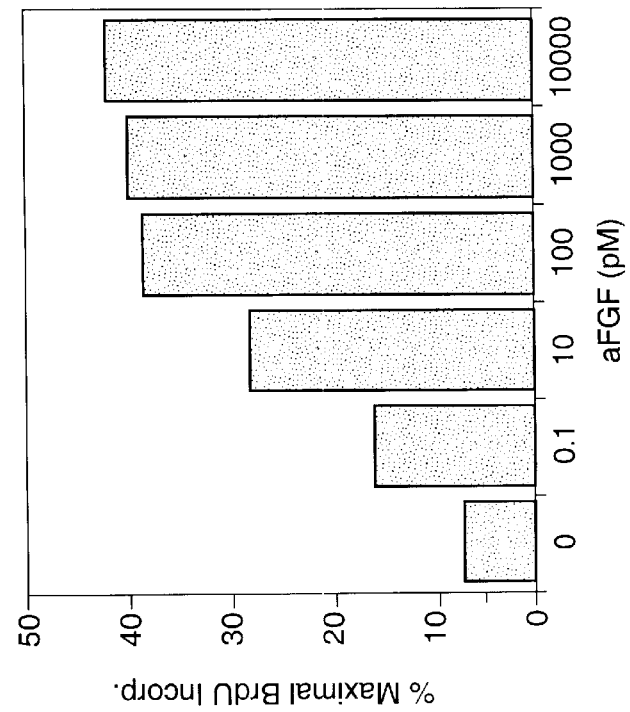

FIG. 20

Degenerate Oligonucleotide Probes for Factor I & Factor II

| Oligo | Sequence | Peptide | |
|---|---|---|---|
| 535 | TTYAARGGNGAYGCNCAYAC! | GGFI-1 | (SEQ ID NO: 54) |
| 536 | CATRTAYTCRTAYTCRTCNGC! | GGFI-2 | (SEQ ID NO: 55) |
| 537 | TGYTCNGANGCCATYTCNGT! | GGFI-13 | (SEQ ID NO: 56) |
| 538 | TGYTCRCTNGCCATYTCNGT! | GGFI-13 | (SEQ ID NO: 57) |
| 539 | CCDATNACCATNGGNACYTT! | GGFI-17 | (SEQ ID NO: 58) |
| 540 | GCNGCCCANACYTGRTGNAC! | GGFII-1 | (SEQ ID NO: 59) |
| 541 | GCYTCNGGYTCCATRAARAA! | GGFII-2 | (SEQ ID NO: 60) |
| 542 | CCYTCDATNACNACRAACCA! | GGFII-4 | (SEQ ID NO: 61) |
| 543 | TCNGCRAARTANCCNGC! | GGFI-11 | (SEQ ID NO: 62) |
| 544 | GCNGCNAGNGCYTCYTTNGC! | GGFI-14 | (SEQ ID NO: 63) |
| 545 | GCNGCYAANGCYTCYTTNGC! | GGFI-14 | (SEQ ID NO: 64) |
| 546 | TTYTTNGCYTGNAGNACRAA! | GGFI-15 | (SEQ ID NO: 65) |
| 551 | TTYTTNGCYTGYAANACRAA! | GGFI-15 | (SEQ ID NO: 66) |
| 568 | TGNACNAGYTCYTGNAC! | GGFII-8 | (SEQ ID NO: 67) |
| 569 | TGNACYAAYTCYTGNAC! | GGFII-8 | (SEQ ID NO: 68) |
| 609 | CATRTAYTCNCCNGARTCNGC! | GGFII-12 | (SEQ ID NO: 69) |
| 610 | CATRTAYTCNCCRCTRTCNGC! | GGFII-12 | (SEQ ID NO: 70) |
| 649 | NGARTCNGCYAANGANGCYTT! | GGFII-12 | (SEQ ID NO: 71) |
| 650 | NGARTCNGCNAGNGANGCYTT! | GGFII-12 | (SEQ ID NO: 72) |
| 651 | RCTRTCNGCYAANGANGCYTT! | GGFII-12 | (SEQ ID NO: 73) |
| 652 | RCTRTCNGCNAGNGANGCYTT! | GGFII-12 | (SEQ ID NO: 74) |
| 653 | NGARTCNGCYAARCTNGCYTT! | GGFII-12 | (SEQ ID NO: 75) |
| 654 | NGARTCNGCNAGRCTNGCYTT! | GGFII-12 | (SEQ ID NO: 76) |
| 655 | RCTRTCNGCYAARCTNGCYTT! | GGFII-12 | (SEQ ID NO: 78) |
| 656 | RCTRCTNGCNAGRCTNGCYTT! | GGFII-12 | (SEQ ID NO: 79) |
| 659 | ACNACNGARATGGCTCNNGA! | GGFI-13 | (SEQ ID NO: 80) |
| 660 | ACNACNGARATGGCAGYNGA! | GGFI-13 | (SEQ ID NO: 81) |
| 661 | CAYCARGTNTGGGCNGCNAA! | GGFII-1 | (SEQ ID NO: 82) |
| 662 | TTYGTNGTNATHGARGGNAA! | GGFII-4 | (SEQ ID NO: 83) |
| 663 | AARGGNGAYGCNCAYACNGA! | GGFI-1 | (SEQ ID NO: 84) |
| 664 | GARGCNYTNGCNGCNYTNAA! | GGDI-14 | (SEQ ID NO: 85) |
| 665 | GTNGGNTCNGTNCARGARYT! | GGFII-8 | (SEQ ID NO: 86) |
| 666 | GTNGGNAGYGTNCARGARYT! | GGFII-8 | (SEQ ID NO: 87) |
| 694 | NACYTTYTTNARHATYTGNCC! | GGFI-17 | (SEQ ID NO: 88) |

FIG. 21

Putative Bovine Factor II Gene Sequences (SEQ ID NO: 89)
(SEQ ID NO: 390)

```
                                                                                              53
TCTAAA AAC TAC AGA GAC TGT ATT TTC ATG ATC ATA GTT CTG TGA AAT ATA
       Asn Tyr Arg Asp Cys Ile Phe Met Ile Ile Val Leu Xaa Asn Ile

101
CTT AAA CCG CTT TGG TCC TGA TCT TGT AGG AAG TCA GAA CTT CGC ATT
Leu Lys Pro Leu Trp Ser Xaa Ser Cys Arg Lys Ser Glu Leu Arg Ile

149
AGC AAA GCG TCA CTG GCT CTG GAT TCT GGA GAA TAT ATG TGC AAA GTG ATC
Ser Lys Ala Ser Leu Ala Asp Ser Gly Glu Tyr Met Cys Lys Val Ile

197
AGC AAA CTA GGA AAT GAC AGT GCC TCT AAC ATC ACC ATT GTG GAG
Ser Lys Leu Gly Asn Asp Ser Ala Ser Asn Ile Arg Ile Val Glu

245
TCA AAC GGT AAG AGA TGC CTA CTG CGT GCT ATT TCT CAG TCT CTA AGA
Ser Asn Gly Lys Arg Cys Leu Leu Arg Ala Ile Ser Gln Ser Leu Arg

293
GGA GTG ATC AAG GTA TGT GGT CAC ACT TGA ATC ACG CAG GTG TGT GAA
Gly Val Ile Lys Val Cys Gly His Thr Xaa Ile Thr Gln Val Cys Glu

341
ATC TCA TTG TGA ACA AAT AAA CAT GAA AGG AAA ACT CTA TGT TTG
Ile Ser Leu Xaa Thr Asn Lys Asn His Glu Arg Lys Thr Leu Cys Leu

389
AAA TAT CTT ATG GGT CCT GTA AAG CTC TTC ACT CCA TAA GGT GAA
Lys Tyr Leu Met Gly Pro Val Lys Leu Phe Thr Pro Xaa Gly Glu

417
ATA GAC CTG AAA TAT ATA TAG ATT ATT T
Ile Asp Leu Lys Tyr Ile Xaa Ile Ile
```

FIG. 22A

PCR Primers for Factor I & Factor II

Degenerate PCR Primers

| Oligo | Sequence | Peptide | |
|---|---|---|---|
| 657 | CCGAATTCTGCAGGARACNCARCCNGAYCCNGG! | GGFI-17 | (SEQ ID NO: 90) |
| 658 | AAGGATCCTGCAGNGTRTANGCNCCHATNACCATNGG! | GGFI-17 | (SEQ ID NO: 91) |
| 667 | CCGAATTCTGCAGGCNGAYTCNGGNGARTAYATG! | GGFII-12 | (SEQ ID NO: 92) |
| 668 | CCGAATTCTGCAGGCNGAYATYGGNGARTAYAT! | GGFII-12 | (SEQ ID NO: 93) |
| 669 | AAGGATCCTGCAGNNNCATRTAYTCNCCNGARTC! | GGFII-12 | (SEQ ID NO: 94) |
| 670 | AAGGATCCTGCAGNNNCATRTAYTCNCCRRTRTC! | GGFII-12 | (SEQ ID NO: 95) |
| 671 | CCGAATTCTGCAGCAYCARGTNTGGGCNGCNAA! | GGFII-1 | (SEQ ID NO: 96) |
| 672 | CCGAATTCTGCAGATRTYTTYATGGARCCNGARG! | GGFII-2 | (SEQ ID NO: 97) |
| 673 | CCGAATTCTGCAGGGGNCNCNCNGCNTTYCCNGT! | GGFII-3 | (SEQ ID NO: 98) |
| 674 | CCGAATTCTGCAGTGGTTYGTNGTNATHGARGG! | GGFII-4 | (SEQ ID NO: 99) |
| 677 | AAGGATCCTGCAGYTTNGCNGCCCANACYTGRTG! | GGFII-1 | (SEQ ID NO: 100) |
| 678 | AAGGATCCTGCAGGCYTCNGGYTCCATRAARAA! | GGFII-2 | (SEQ ID NO: 101) |
| 679 | AAGGATCCTGCAGACNGGRAANGCNGNGNGNCC! | GGFII-3 | (SEQ ID NO: 102) |
| 680 | AAGGATCCTGCAGYTTNCCYTCDATNACNACRAAC! | GGFII-4 | (SEQ ID NO: 103) |
| 681 | CATRTAYTCRTAYTCTCNGCAGAARGGNGAYGCNCAYACNGA! | GGFI-2 | (SEQ ID NO: 104) |
| 682 | CCGAATTCTGCAGAARGGNGAYGCNCAYACNGA! | GGFI-1 | (SEQ ID NO: 105) |
| 683 | GCNGCYAANGCYRCYTTNGCAAGGATCCTGCAG! | GGFI-14 | (SEQ ID NO: 106) |
| 684 | GCNGCNAGNGCYTCYTTNGCAAGGATCCTGCAG! | GGFI-14 | (SEQ ID NO: 107) |
| 685 | TCNGCRAARTANCCNGCAAGGATCCTGCAG! | GGFI-1 | (SEQ ID NO: 108) |

FIG. 22B

PCR Primers for Factor I & Factor II

Unique PCR Primers for Factor II

| Oligo | Sequence | Comment | |
|---|---|---|---|
| 711 | CATCGATCTGCAGGCTGATTCTGGAGAATATATGTGCA! | 3' RACE | (SEQ ID NO: 109) |
| 712 | AAGGATCCTGCAGCCACATCTGAGTCGACATCGATT! | 3' RACE | (SEQ ID NO: 110) |
| 713 | CCGAATTCTGCAGTGATCAGCAAACTAGGAAATGACA! | 3' RACE | (SEQ ID NO: 111) |
| 721 | CATCGATCTGCAGCCTAGTTTGCTGATCACTTTGCAC! | 5' RACE | (SEQ ID NO: 112) |
| 722 | AAGGATCCTGCAGTATATTCTCCAGAATCAGCCAGTG! | 5' RACE; ANCHORED | (SEQ ID NO: 113) |
| 725 | AAGGATCCTGCAGGCACGCAGTAGGCATCTCTTA! | EXON A | (SEQ ID NO: 114) |
| 726 | CCGAATTCTGCAGCAGAACTTCGCATTAGCAAAGC! | EXON A | (SEQ ID NO: 115) |
| 771 | CATCCCGGGATGAAGAGTCAGGAGTCTGTGGCA! | EXONS B+A | (SEQ ID NO: 116) |
| 772 | ATACCCGGGCTGCAGACAATGAGATTTCACACACCTGCG! | | (SEQ ID NO: 117) |
| 773 | AAGGATCCTGCAGTTTGGAACCTGCCACAGACTCCT! | ANCHORED | (SEQ ID NO: 118) |
| 776 | ATACCCGGGCTGCAGATGAGATTTCACACACCTGCGTGA! | EXONS B+A | (SEQ ID NO: 119) |

Summary of Contiguous GGF-II cDNA Structures & Sequences

Alternative Gene Products of Putative Bovine GGF-II

FIG. 26

GGF-II Peptides Identified in Deduced Amino Acid Sequences of Putative Bovine GGF-II Proteins

| Peptide | Pos. | | Sequence match | ID Sequences |
|---|---|---|---|---|
| II-1 | 1: | | VHQVWAAK<br>HQVWAAK AAGLK | (SEQ ID NO: 45)<br>(SEQ ID NO:120) |
| II-10 | 14: | GGLKK | DLLLXV<br>dslltv RLGAW | (SEQ ID NO: 53)<br>(SEQ ID NO:121) |
| II-03 | 21: | LLTVR | LGAWGPPAFPVXY<br>lgawghpafpscg RLKED | (SEQ ID NO:122)<br>(SEQ ID NO:123) |
| II-02 | 41: | KEDSR | YIFFMEPEAXSSG<br>YIFFMEPEANSSG GPGRL | (SEQ ID NO:124)<br>(SEQ ID NO:125) |
| II-6 | 103: | VAGSK | LVLR<br>LVLR CETSS | (SEQ ID NO: 42)<br>(SEQ ID NO:126) |
| I-18 | 112: | CETSS | EYKCLKFKWFKKATVM<br>eysslkfkwfkngsel SRKNK | (SEQ ID NO:127)<br>(SEQ ID NO:128) |
| II-12 | 151: | ELRIS | KASLADSGEYMXK<br>KASLADSGEYMCK VISKL | (SEQ ID NO: 52)<br>(SEQ ID NO:130) |
| I-07 | 152: | LRISK | ASLADEYEYMRK<br>asladsgeymck VISKL | (SEQ ID NO:131)<br>(SEQ ID NO:132) |

FIG. 27A (SEQ ID NO: 133)
(SEQ ID NO: 383)

```
CCTGCAG CAT CAA GTG TGG GCG GCG AAA GCC GGG GGC TTG AAG GAC TCG CTG   55
        His Gln Val Trp Ala Ala Lys Ala Gly Gly Leu Lys Asp Ser Leu

CTC ACC GTG CGC CTG GGC GCC TGG CAC CCC GCC TTC CCC TCC TGC           103
Leu Thr Val Arg Leu Gly Ala Trp His Pro Ala Phe Pro Ser Cys

GGG CGC CTC AAG GAG GAC AGC AGG TAC ATC TTC TTC ATG GAG CCC GAG       151
Gly Arg Leu Lys Glu Asp Ser Arg Tyr Ile Phe Phe Met Glu Pro Glu

GCC AAC AGC AGC GGC GGG CCC CGC GGC CGC CCG AGC CTC CTT CCC CCC       199
Ala Asn Ser Ser Gly Gly Pro Arg Gly Arg Pro Ser Leu Leu Pro Pro

TCT CGA GAC CCG GAA CCT CAA GGA GAA GGT CAG CAG CCG GGT GCT GTG       247
Ser Arg Asp Pro Glu Pro Gln Gly Glu Gly Gln Gln Pro Gly Ala Val

CAA CGG TGC GCC TTG CCT CCC CGC TTG AAA GAG ATG AAG AGT CAG GAG       295
Gln Arg Cys Ala Leu Pro Pro Arg Leu Lys Glu Met Lys Ser Gln Glu

TCT GTG GCA GGT TCC AAA CTA GTG CTT CGG TGC GAG ACC AGT TCT GAA       343
Ser Val Ala Gly Ser Lys Leu Val Leu Arg Cys Glu Thr Ser Ser Glu

TAC TCC TCT CTC AAG TTC TGG TTC TTC AAG AAT GGG AGT AGT TTA AGC       391
Tyr Ser Ser Leu Lys Phe Trp Phe Phe Lys Asn Gly Ser Ser Leu Ser

CGA AAG AAC CCA GAA AAC ATC ATA CAG ATA CTG GCT GAT TCT GGA AAG       439
Arg Lys Asn Pro Glu Asn Ile Ile Gln Ile Leu Ala Asp Ser Gly Lys

TCA GAA CTT CGC ATT AGC AGC TCA GGA AAA CTA AAT GAC AGT GCC TAT       487
Ser Glu Leu Arg Ile Ser Ser Ser Gly Lys Leu Asn Asp Ser Ala Tyr

ATG TGC AAA GTG GAG GTG GAG TCA AAC ATC AGA GGT AAG AAG TGC AAC       535
Met Cys Lys Val Glu Val Glu Ser Asn Ile Arg Gly Lys Lys Cys Asn

ATC ACC ATT GTC ATC ATC GAG GGA GTG ATC GTA AAG GTA TCT CTG ATT       583
Ile Thr Ile Val Ile Ile Glu Gly Val Ile Val Lys Val Ser Leu Ile

TCT CAG TCT CTA AGA GGA CTA AGG AGA TGT TGT TGT CAC ACT               625
Ser Gln Ser Leu Arg Gly Leu Arg Arg Cys Cys Cys His Thr

TGAATCACGC AGGTGTGTGA AATCTCATTG TGAACAAATA AAAATCATGA AAGGAAAAA      685

AAAAAAAAAA AATCGATGTC GACTCGAGAT GTGGCTGCAG GTCGACTCTA GAGGATCCC      744
```

FIG. 27B

Nucleotide Sequences & Deduced Amino Acid Sequences of GGF2BPP2

```
(SEQ ID NO: 134) CCTGCAG CAT CAA GTG TGG GCG AAA GCC GGG GGC TTG AAG AAG GAC TCG CTG         55
(SEQ ID NO: 385)         His Gln Val Trp Ala Lys Ala Gly Gly Leu Lys Lys Asp Ser Leu

CTC ACC GTG CGC CTG GGC GCC CAC GGC CCC GCC TTC CCC TCC TGC             103
                 Leu Thr Val Arg Leu Gly Ala Trp Gly His Pro Ala Phe Pro Ser Cys

GGG CGC CTC AAG GAG GAC AGC AGG TAC ATC TTC ATG GAG CCC GAG             151
                 Gly Arg Leu Lys Glu Asp Ser Arg Tyr Ile Phe Met Glu Pro Glu

GCC AAC AGC AGC GGC GGG CCC GGC AGC CTC CTT CCC CCC                     199
                 Ala Lys Ser Ser Gly Gly Pro Gly Arg Leu Pro Ser Leu Leu Pro Pro

TCT CGA GAC GGG CCG GAA CCT CAA GGT CAG CCG GGT GCT GTG                 247
                 Ser Arg Asp Gly Pro Glu Pro Gln Gly Gln Pro Gly Ala Val

CAA CGG TGC GCC TTG CCT CCC AAA CTA GTG CTT CGC TGC GAG GAG             295
                 Gln Arg Cys Ala Leu Pro Pro Lys Leu Val Leu Arg Cys Gln Glu

TCT GTG GCA GGT TCC AAG CTC TTC AAG TGG TTC CGG TGC GAG TCT GAA         343
                 Ser Val Ala Gly Ser Lys Leu Phe Lys Trp Phe Arg Cys Glu Ser Glu

TAC TCC TCT CTC AAG GAA AAC ATC AAG ATA CAG AAA AGG CCG GGG AAG         391
                 Tyr Ser Ser Leu Lys Glu Asn Ile Lys Ile Gln Lys Arg Pro Gly Lys

CGA AAG AAC AAA CCA GAA AAC AAA GCG TCA CTG GCT GAT TCT GGA TAT         439
                 Arg Lys Asn Lys Gly Glu Asn Lys Ala Ser Leu Ala Asp Ser Gly Tyr

TCA GAA CTT CGC ATT AGC ATC AGC GAA AAT GAC AGT GCC AGT GAA TAT         487
                 Ser Glu Leu Arg Ile Ser Ile Ser Ala Ser Glu Asn Asp Ser Gly Glu Tyr

ATG TGC AAA GTG ATC AGC AAA CTA GGA AAT GAC AGT GCC AAC                 535
                 Met Cys Lys Val Ile Ser Lys Leu Gly Asn Asp Ser Ala Asn
```

FIG. 27C

Nucleotide Sequences & Deduced Amino Acid Sequences of GG2BPP2

```
ATC ACC ATT GTG GAG TCA AAC GCC ACA TCC ACA TCT ACA GCT GGG ACA         583
Ile Thr Ile Val Glu Ser Asn Ala Thr Ser Thr Ser Thr Ala Gly Thr

AGC CAT CTT GTC AAG TGT GCA GAG AAG GAG AAA ACT TTC TGT GTG AAT         631
Ser His Leu Val Lys Ser Ala Glu Lys Glu Lys Thr Phe Cys Val Asn

GGA GGC TGC TTC ATG GTG AAA GAC CTT TCA AAT CCC TCA AGA TAC             679
Gly Gly Cys Phe Met Val Lys Asp Leu Ser Asn Pro Ser Arg Tyr

TTG TGC AAG TGC CAA CCT GGA TTC ACT GGA GCG AGA TGT ACT GAG AAT         727
Leu Cys Lys Cys Gln Pro Gly Phe Thr Gly Ala Arg Cys Thr Glu Asn

GTG CCC ATG AAA GTC AAA ACC CAA GAA AGT GCC CAA ATG AGT TTA CTG         775
Val Pro Met Lys Val Lys Thr Gln Glu Ser Ala Gln Met Ser Leu Leu

GTG ATC GCT GCC AAA ACT ACG TAATGGCCAG CTTCTACAGT ACGTCCACTC            826
Val Ile Ala Ala Lys Thr Thr

CCTTTCTGTC TCTGCCTGAA TAGCGCATCT CAGTGGGTGC CGCTTTCTTG TTGCCGCATC       886

TCCCCTCAGA TTCCTCCTAG AGCTAGATGC GTTTTACCAG GTCTAACATT GACTGCCTCT       946

GCCTGTCGCA TGAGAACATT AACACAAGCG ATTGTATGAC TTCCTCTGTC CGTGACTAGT      1006

GGGCTCTGAG CTACTCGTAG GTGCGTAAGG CTCCAGTGTT TCTGAAATTG ATCTTGAATT      1066

ACTGTGATAC GACATGATAG TCCCTCTCAC CCAGTGCAAT GACAATAAAG GCCTTGAAAA      1126

GTCAAAAAAA AAAAAAAAAA AAAAAATCGA TGTCGACTCG AGATGTGGCT GCAGGTCGAC      1186

TCTAGAG                                                                1193
```

FIG. 27D

Nucleotide Sequences & Deduced Amino Acid Sequences of GGF2BPP3

```
(SEQ ID NO: 135) CCTGCAG CAT CAA GTG TGG GCG AAA GCC GGG GGC TTG AAG AAG GAC TCG CTG   55
(SEQ ID NO: 387)         His Gln Val Trp Ala Lys Ala Gly Gly Leu Lys Lys Asp Ser Leu

CTC ACC GTG CGC CTG GGC GCC TGG GGC CAC CCC GCC TTC CCC TCC TGC         103
                 Leu Thr Val Arg Leu Gly Ala Trp Gly His Pro Ala Phe Pro Ser Cys

GGG CGC CTC AAG GAG GAC AGC AGG TAC ATC TTC ATG GAG CCC GAG             151
                 Gly Arg Leu Lys Glu Asp Ser Arg Tyr Ile Phe Met Glu Pro Glu

GCC AAC AGC AGC GGC GGG GGT CCC CTT CCG AGC CTC CTT CCC CCC             199
                 Ala Asn Ser Ser Gly Gly Pro Leu Pro Ser Leu Leu Pro Pro

TCT CGA GAC GGG CCG GAA CCT CAA GGA GGT CAG CCG GGT GCT GTG             247
                 Ser Arg Asp Gly Pro Glu Pro Gln Gly Gly Gln Pro Gly Ala Val

CAA CGG TGC GCC TTG CCT CCC CGC CGC TTG AAA GAG ATG AAG AGT CAG GAG     295
                 Gln Arg Cys Ala Leu Pro Pro Arg Arg Leu Lys Glu Met Lys Ser Gln Glu

TCT GTG GCA GGT TCC AAA CTA GTG CTT CGG TGC GAG ACC AGT TCT GAA         343
                 Ser Val Ala Gly Ser Lys Leu Val Leu Arg Cys Glu Thr Ser Ser Glu

TAC TCC TCT CTC AAG TTC TTC TGG TTC AAG AAT GGG AGT GAA TTA AGC         391
                 Tyr Ser Ser Leu Lys Phe Phe Trp Phe Lys Asn Gly Ser Glu Leu Ser

CGA AAG AAA CCA GAA AAC ATC AAG ATA CAG AAA AGG CCG GGG AAG             439
                 Arg Lys Lys Pro Glu Asn Ile Lys Ile Gln Lys Arg Pro Pro Lys

TCA GAA CTT CGC ATT AGC AAA GCG TCA CTG GCT GAT TCT GGA GAA TAT         487
                 Ser Glu Leu Arg Ile Ser Lys Ala Ser Leu Ala Asp Ser Gly Glu Tyr
```

FIG. 27E

Nucleotide Sequences & Deduced Amino Acid Sequences of GGF2BPP3

```
ATG TGC AAA GTG ATC AGC AAA CTA GGA AAT GAC AGT GCC TCT GCC AAC    535
Met Cys Lys Val Ile Ser Lys Leu Gly Asn Asp Ser Ala Ser Ala Asn

ATC ACC ATT GTG GAG TCA AAC GCC ACA TCC ACA TCT ACA GCT GGG ACA    583
Ile Arg Ile Val Glu Ser Asn Ala Thr Ser Thr Ser Thr Ala Gly Thr

AGC CAT GTC AAG TGT GCA GAG AAA GAG ACT TTC TGT GTG AAT            631
Ser His Leu Val Lys Cys Ala Glu Lys Glu Thr Phe Cys Val Asn

GGA GGC GAG TGC TTC ATG GTG AAA GAC CTT TCA AAT CCC TCA AGA TAC    679
Gly Gly Glu Cys Phe Met Val Lys Asp Leu Ser Asn Pro Ser Arg Tyr

TTG TGC AAG TGC CCA AAT GAG TTT ACT GGT GAT CGC TGC CAA AAC TAC    727
Leu Cys Lys Cys Pro Asn Glu Phe Thr Gly Asp Arg Cys Gln Asn Tyr

GTA ATG GCC AGC TTC TAC AGT ACG TCC ACT CCC TTT CTG TCT CTG CCT    775
Val Met Ala Ser Phe Tyr Ser Thr Ser Thr Pro Phe Leu Ser Leu Pro

GAA TAGCGCATCT CAGTCGGTGC CGCTTTCTTG TTGCCGCATC TCCCCCTCAGA TTCCGCCTAG    838
Glu

AGCTAGATGC GTTTTACCAG GTCTAACATT GACTGCCTCT GCCTGTCGCA TGAGAACATT    898

AACACAAGCG ATTGTATGAC TTCCCTCTGTC CGTGACTAGT GGGCTCTGAG CTACTCGTAG    958

GTGCGTAAGG CTCCAGTGTT TCTGAAATTG ATCTTGAATT ACTGTGATAC GACATGATAG    1018

TCCCTCTCAC CCAGTGCAAT GACAATAAAG GCCTTGAAAA GTCAAAAAAA AAAAAAAAAA    1078

AAAAATCGAT GTCGACTCGA GATGTGGCTG                                    1108
```

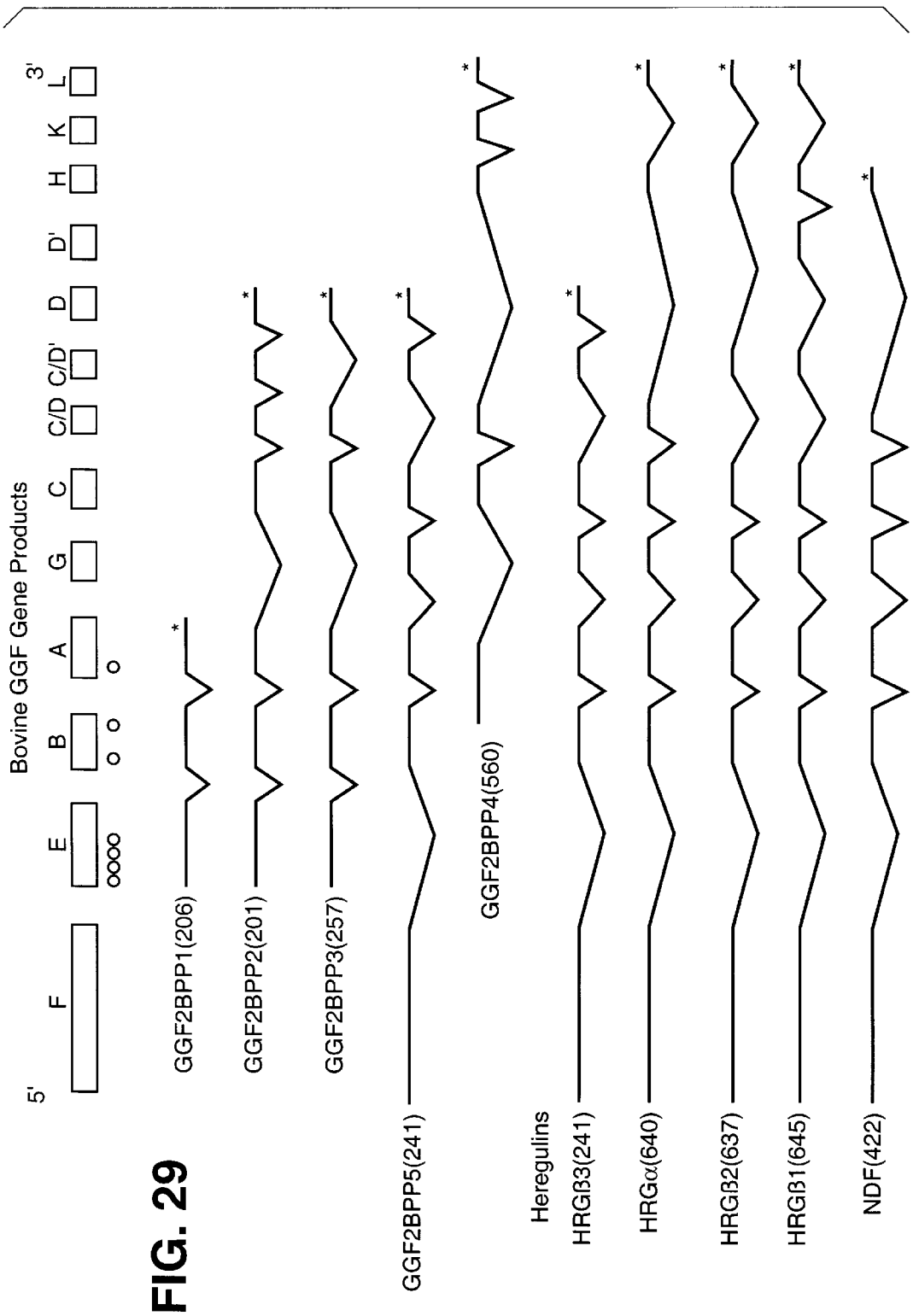

FIG. 30A

Coding Segments of Glial Growth Factor/Heregulin Gene

```
CODING SEGMENT F: (bovine,top; human, bottom)

(SEQ ID NO: 136) AGTTTCCCCC CCCAACTTGT CGGAACTCTG GGCTCGCGCG CAGGGCAGGA GCGGAGCGGC      60
                 |||||||||| |||||||||| |||||||||| |||||||||| |||||||||| ||||||||||
                 GGCGGCTGCC CAGGCGATGC GAGCGCGGGC CGGACGGTAA TCGCCCTCTCC CTCCCTCGGGC      120
                 |||||||||| |||||||||| |||||||||| |||||||||| |||||||||| ||||||||||
                 TGCGAGCGCG CCGGACCGAG GCAGCGACAG GAGCGGACCG CGGGCGGGAAC CGAGGACTCC      180
                 |||||||||| |||||||||| |||||||||| |||||||||| |||||||||| ||||||||||
                 CCAGCGGCGC GCCAGCAGGA GCCACCCCGC GAGNCGTGCG ACCGGGACGG AGCGCCCGCC      240
                 |||||||||| |||||||||| |||||||||| |||||||||| |||||||||| ||||||||||
                 AGTCCCAGGT GGCCCGGACC GCACGTGCG TCCCCGGCT CCCCGCCGGC GACAGGAGAC      300
                 |||||||||| |||||||||| |||||||||| |||||||||| |||||||||| ||||||||||
                 GCTCCCCCCC ACGCCGGCGC CGCCTCGGCC CGGTCGCTGG CCCGCCTCCA CTCCGGGGAC      360
                 |||||||||| |||||||||| ||||||||    ||  ||||   |||     ||||||||||

(SEQ ID NO: 173) CGCGAG  CGCCTCAGCG CGGCCGCTCG CTCTC..CCC CTCGAGGGAC

AAACTTTTCC CGAAGCCGAT CCCAGCCCTC GGACCCAAAC TTGTCGCGCG TCGCCTTCGC      420
                 |||||||||| | ||| ||||  ||||||||| ||||||||||     ||||||  ||||||||
                 AAACTTTTCC CAAACCCGAT CCGAGCCCTT GGACCAAA.. ......... C TCGCCTGCGC (SEQ ID NO: 391) Met Ser Glu Arg Arg    474
                                                                    ATG TCG GAG CGC AGA
                                                                    ||| ||| ||| ||| |||
                 CGGGAGCCGT CCGGCGCAGAG CGTGCACTTC TCGGGCGAG ATG TCG GAG CGC AGA
                 |||||||||  |||||||||| |||||||||| |||||||||  ||| ||| ||| ||| |||
                 CGAGAGCCGT CCGCGTAGAG CGCTC CGTC TCCGGCGAG ATG TCC GAG CGC AAA
                                                        (SEQ ID NO: 403)              K

Glu Gly Lys Gly Lys Gly Lys Gly Gly Lys Lys Asp Arg Gly Ser Gly                       522
GAA GGC AAA GGC AAA GGC AAG GGG GGC AAG AAG GAC CGA GGC TCC GGG
||| ||| ||  ||| ||  ||| ||| ||  ||  ||| ||| ||| ||  ||| ||| |||
GAA GGC AGA GGC AAA GGC AAG GGC AAG AAG AAG GAG CGA GGC TCC GGC
                                        E

Lys Lys Pro Val Pro Ala Gly Ala Gly Gly Pro Ser Pro Ala                               559
AAG AAG CCC GTG CCC GCG GCT GGC GCG CCG AGC CCA G
||| ||| ||  || | || |  ||| |   ||| ||  ||| ||| |
AAG AAG CCG GAG TCC GCG GCG GGC AGC CAG AGC CCA G
        E                                S   Q
```

FIG. 30B

CODING SEGMENT E:

(SEQ ID NO: 137)
(SEQ ID NO: 392)

```
CC  CAT CAN GTG TGG GCG AAA GCC GGG GGC TTG AAG AAG GAC TCG        47
    His Gln Val Trp Ala Lys Ala Gly Gly Leu Lys Lys Asp Ser

CTG CTC ACC GTG CGC CTG GGC GCC TGG GGC CAC CCC TTC CCC TCC        95
Leu Leu Thr Val Arg Leu Gly Ala Trp Gly His Pro Ala Phe Pro Ser

TGC GGG CGC CTC AAG GAG GAC AGC GAC AGG TAC ATC TTC TTC ATG GAG CCC   143
Cys Gly Arg Leu Lys Glu Asp Ser Arg Tyr Ile Phe Phe Met Glu Pro

GAG GCC AAC AGC AGC GGC GGG CCC CGG CTT CCG AGC CTC CTT CCC        191
Glu Ala Asn Ser Ser Gly Gly Pro Arg Leu Pro Ser Leu Leu Pro

CCC TCT CGA GAC GGG CCG GAA CCT CAA GGA GGT CAG CCG GGT GCT        239
Pro Ser Arg Asp Gly Pro Glu Gln Gly Gly Gln Pro Gly Ala

GTG CAA CGG TGC G                                                  252
Val Gln Arg Cys
```

FIG. 30C

CODING SEGMENT B: (bovine, top; human, bottom)

```
                    Leu Pro Pro Arg Leu Lys Glu Met Lys Ser Gln Glu Ser Val Ala
(SEQ ID NO: 393) CC TTG CCT CCC CGC TTG AAA GAG ATG AAG AGT CAG GAG TCT GTG GCA    47
(SEQ ID NO: 138)    ||| ||| ||| ||| ||| ||| ||| ||| ||| ||| ||| ||| ||| ||| |||
(SEQ ID NO: 174) CC TTG CCT CCC CGA TTG AAA GAG ATG AAA AGC CAG GAA TCG GCT GCA
(SEQ ID NO: 405)                                                          A

Gly Ser Lys Leu Val Leu Arg Cys Glu Thr Ser Ser Glu Tyr Ser Ser
                 GGT TCC AAA CTA GTG CTT CGG TGC GAG ACC AGT TCT GAA TAC TCC TCT    95
                 ||| ||| ||| ||| ||| ||| ||| ||| ||| ||| ||| ||| ||| ||| ||| |||
                 GGT TCC AAA CTA GTC CTT CGG TGT GAA ACC AGT TCT GAA TAC TCC TCC

Leu Lys Phe Lys Trp Phe Lys Asn Gly Ser Glu Leu Ser Arg Lys Asn
                 CTC AAG TTC AAG TGG TTC AAG AAT GGG AGT GAA TTA AGC CGA AAG AAC   143
                 ||| ||| ||| ||| ||| ||| ||| ||| ||| ||| ||| ||| ||| ||| ||| |||
                 CTC AGA TTC AAG TGG TTC AAG AAT GGG AAT GAA TTG AGC CGA AAA AAC
                     R                           N           N

Lys Pro Gln Asn Ile Lys Ile Gln Lys Arg Pro Gly
                 AAA CCA CAA AAC ATC AAG ATA CAG AAA AGG CCG GG                    178
                 ||| ||| ||| ||| ||| ||| ||| ||| ||| ||| ||| ||
                 AAA CCA CAA AAT ATC AAG ATA CAA AAG AAG CCA GG
                                                     K
```

FIG. 30D

CODING SEGMENT A: (bovine, top; human, bottom)

```
                     Lys Ser Glu Leu Arg Ile Ser Lys Ala Ser Leu Ala Asp Ser Gly
(SEQ ID NO: 394)     AAG TCA GAA CTT CGC ATT AGC AAA GCG TCA CTG GCT GAT TCT GGA
(SEQ ID NO: 139) G       ||| ||| ||| ||| ||| ||| ||| ||| ||| ||| ||| ||| ||| |||         46
                     AAG TCA GAA CTT CGC ATT AAC AAA GCA TCA CTG GCT GAT TCT GGA
                                             N

Glu Tyr Met Cys Lys Val Ile Ser Lys Leu Gly Asn Asp Ser Ala Ser
(SEQ ID NO: 175) G   GAA TAT ATG TGC AAA GTG ATC AGC AAA CTA GGA AAT GAC AGT GCC TCT
(SEQ ID NO: 406)         ||| ||| ||| ||| ||| ||| ||| ||| ||| ||| ||| ||| ||| ||| |||    94
                     GAG TAT ATG TGC AAA GTG ATC AGC AAA TTA GGA AAT GAC AGT GCC TCT

Ala Asn Ile Thr Ile Val Glu Ser Asn Ala
                     GCC AAC ATC ACC ATT GTG GAG TCA AAC G
                         ||| ||| ||| ||| ||| ||| ||| ||| —                                122
                     GCC AAT ATC ACC ATC GTG GAA TCA AAC G
```

FIG. 30E

```
CODING SEGMENT A':
(SEQ ID NO: 140)  TCTAAAACTA CAGAGACTGT ATTTTCATGA TCATCATAGT TCTGTGAAAT ATACTTAAAC    60

CGCTTTGGTC CTGATCTTGT AGG AAG TCA GAA CTT CGC ATT AGC AAA GCG         110
(SEQ ID NO: 400)                              Lys Ser Glu Leu Arg Ile Ser Lys Ala

TCA CTG GCT GAT TCT GGA GAA TAT ATG TGC AAA GTG ATC AGC AAA CTA      158
                  Ser Leu Ala Asp Ser Gly Glu Tyr Met Cys Lys Val Ile Ser Lys Leu

GGA AAT GAC AGT GCC TCT GCC AAC ATC ACC ATT GTG GAG TCA AAC GGT      206
                  Gly Asn Asp Ser Ala Ser Ala Asn Ile Thr Ile Val Glu Ser Asn Gly

AAG AGA TGC CTA CTG CGT GCT ATT TCT CAG TCT CTA AGA GGA GTG ATC      254
                  Lys Arg Cys Leu Leu Arg Ala Ile Ser Gln Ser Leu Arg Gly Val Ile

AAG GTA TGT GGT CAC ACT TGAATCACGC AGGTGTGTGA AATCTCATTG             302
                  Lys Val Cys Gly His Thr

TGAACAAATA AAAATCATGA AAGGAAAACT CTATGTTTGA AATATCTTAT GGGTCCTCCT    362

GTAAAGCTCT TCACTCCATA AGGTGAAATA GACCTGAAAT ATATATAGAT TATTT          417
```

FIG. 30F

CODING SEGMENT G: (bovine, top; human, bottom)

```
         Glu Ile Thr Thr Gly Met Pro Ala Ser Thr Glu Thr Ala Tyr Val Ser
         AG  ATC ACC ACT GGC ATG CCA GCC TCA ACT GAG ACA GCG TAT GTG TCT
         ||| ||| ——— ||| ——— ||| ||| ||| ||| ||| ||| ——— ——— ||| ||| |||
         AG  ATC ATC ACT GGT ATG CCA GCC TCA ACT GAA GGA GCA TAT GTG TCT
                 I                                     G                                    47

Ser Glu Ser Pro Ile Arg Ile Ser Val Ser Thr Glu Gly Thr Asn Thr
         TCA GAG TCT CCC ATT AGA ATA TCA GTA TCA ACA GAA GGA ACA AAT ACT
         ||| ——— ||| ——— ||| ——— ||| ——— ||| ——— ||| ——— ||| ——— ——— |||
         TCA GAG TCT CCC ATT AGA ATA TCA GTA TCC ACA GAA GGA GCA AAT ACT
                                                                   A                         95

Ser Ser Ser
         TCT TCA T
         ||| ——— |
         TCT TCA T                                                                            102
```

(SEQ ID NO: 395)
(SEQ ID NO: 141)

(SEQ ID NO: 176)
(SEQ ID NO: 407)

FIG. 30G

CODING SEGMENT C: (bovine, top; human, bottom)

```
                    Thr Ser Thr Ser Thr Ala Gly Thr Ser His Leu Val Lys Cys Ala
(SEQ ID NO: 396)    ACA TCC ACA TCT ACA GCT GGG ACA AGC CAT CTT GTC AAG TGT GCA     47
(SEQ ID NO: 160) CC  |   |   |   |   |   |   |   |   |   |   |   |   |   |   |
                     |   |   |   |   |   |   |   |   |   |   |   |   |   |   |
(SEQ ID NO: 177) CT ACA TCT ACA TCC ACC ACT GGG ACA AGC CAT CTT GTA AAA TGT GCG
(SEQ ID NO: 408)                         T

Glu Lys Glu Lys Thr Phe Cys Val Asn Gly Gly Glu Cys Phe Met Val
                    GAG AAG GAG AAA ACT TTC TGT GTG AAT GGA GGC GAG TGC TTC ATG GTG     95
                     |   |   |   |   |   |   |   |   |   |   |   |   |   |   |   |
                     |   |   |   |   |   |   |   |   |   |   |   |   |   |   |   |
                    GAG AAG GAG AAA ACT TTC TGT GTG AAT GGA GGG GAG TGC TTC ATG GTG

Lys Asp Leu Ser Asn Pro Ser Arg Tyr Leu Cys
                    AAA GAC CTT TCA AAT CCC TCA AGA TAC TTG TGC     128
                     |   |   |   |   |   |   |   |   |   |   |
                     |   |   |   |   |   |   |   |   |   |   |
                    AAA GAC CTT TCA AAC CCC TCG AGA TAC TTG TGC
```

FIG. 30H

CODING SEGMENT C/D: (bovine, top; human, bottom)

```
                Lys Cys Gln Pro Gly Phe Thr Gly Ala Arg Cys Thr Glu Asn Val Pro    48
(SEQ ID NO: 397) AAG TGC CAA CCT GGA TTC ACT GGA GCG AGA TGT ACT GAG AAT GTG CCC
(SEQ ID NO: 142) ||| ||| ||| ||| ||| ||| ||| ||| || ||| ||| ||| ||| ||| ||| |||
                AAG TGC CAA CCT GGA TTC ACT GGA GCA AGA TGT ACT GAG AAT GTG CCC

Met Lys Val Gln Thr Gln Glu                                         69
(SEQ ID NO: 178) ATG AAA GTC CAA ACC CAA GAA
(SEQ ID NO: 409) ||| ||| ||| ||| |-| ||| |||
                                  N
                ATG AAA GTC CAA AAC CAA GAA
```

FIG. 30I

CODING SEGMENT C/D': (bovine and human)

```
     Lys Cys Pro Asn Glu Phe Thr Gly Asp Arg Cys Gln Asn Tyr Val Met
     AAG TGC CCA AAT GAG TTT ACT GGT GAT CGC TGC CAA AAC TAC GTA ATG   48
         |||     |||     |||     |||     |||     |||     |||     |||
     AAG TGC CCA AAT GAG TTT ACT GGT GAT CGC TGC CAA AAC TAC GTA ATG

Ala Ser Phe Tyr
     GCC AGC TTC TAC                                                   60
     |||         |||
     GCC AGC TTC TAC
```

(SEQ ID NO: 401)
(SEQ ID NO: 143)

FIG. 30J

CODING SEGMENT D: (bovine, top; human, bottom)

```
     Ser Thr Ser Thr Pro Phe Leu Ser Leu Pro Glu *
     AGT ACG TCC ACT CCC TTT CTG TCT CTG CCT GAA TAG                   36
         |||     |||     |||     |||     |||     |||
     AGT ACG TCC ACT CCC TTT CTG TCT CTG CCT GAA TAG
```

(SEQ ID NO: 402)
(SEQ ID NO: 144)

FIG. 30K

CODING SEGMENT D': (human)

```
     Lys His Leu Gly Ile Glu Phe Met Glu
     AAG CAT CTT GGG ATT GAA TTT ATG GAG                               27
```

(SEQ ID NO: 410)
(SEQ ID NO: 145)

FIG. 30L

CODING SEGMENT H: (bovine, top; human, bottom)

```
       Lys Ala Glu Glu Leu Tyr Gln Lys Arg Val Leu Thr Ile Thr Gly Ile
       AAA GCG GAG GAG CTC TAC CAG AAG AGA GTG CTC ACC ATT ACC GGC ATT      48
       ||  ||| ||| ||| ||| ||| ||| ||| ||| ||| ||| ||| ||| ||| ||| |||
       AAG GCG GAG GAG CTG TAC CAG AAG AGA GTG CTG ACC ATA ACC GGC ATC

Cys Ile Ala Leu Leu Val Val Gly Ile Met Cys Val Val Tyr Cys
       TGC ATC GCG CTG CTC GTT GTG GGC ATC ATG TGT GTG GTC TAC TGC          96
       ||| ||| ||| ||| ||| ||| ||| ||| ||| ||| ||| ||| ||| ||| |||
       TGC ATC GCC CTT CTG GTC GTG GGC ATG ATG TGT GTG GTG GCC TAC TGC
                                                           A

Lys Thr Lys Lys Gln Arg Lys Lys Leu His Asp Arg Leu Arg Gln Ser
       AAA ACC AAG AAA CAA CGG AAA AAG CTT CAT GAC CGG CTT CGG CAG AGC     144
       ||| ||| ||| ||| ||| ||| ||| ||| ||| ||| ||| ||| ||| ||| ||| |||
       AAA ACC AAG AAA CAG CGG AAA AAG CTG CAT GAC CGT CTT CGG CAG AGC

Leu Arg Ser Glu Arg Asn Thr Met Met Asn Val Ala Asn Gly Pro His
       CTT CGG TCT GAA AGA AAC ACC ATG ATG AAC GTA GCC AAC GGG CCC CAC     192
       ||| ||| ||| ||| ||| ||  ||| ||| ||| ||| ||  ||| ||| ||| ||| |||
       CTT CGG TCT GAA CGA AAC AAT ATG ATG AAC GTC ATT GCC AAT GGG CCT CAC
                                       N               I

His Pro Asn Pro Pro Glu Asn Val Gln Leu Val Asn Gln Tyr Val
       CAC CCC AAT CCG CCC GAG AAC GTG CAG CTG GTG AAT CAA TAC GTA         240
       ||  ||| ||| ||  ||| ||| ||  ||| ||| ||| ||| ||| ||| ||| |||
       CAT CCT AAC CCA CCC GAG AAT GTC CAG CTG GTG AAT CAA TAC GTA

Ser Lys Asn Val Ile Ser Ser Glu His Ile Val Glu Arg Glu Ala Glu
       TCT AAA AAT GTC ATC TCT AGC GAG CAT ATT GTT GAG AGA GAG GCG GAG     288
       ||| ||| ||  ||| ||| ||  ||| ||| ||| ||| ||| ||| ||| ||| ||  |||
       TCT AAA AAC GTC ATC TCC AGT GAG CAT ATT GTT GAG AGA GAA GCA GAG
```

(SEQ ID NO: 398)
(SEQ ID NO: 146)

(SEQ ID NO: 44)
(SEQ ID NO: 411)

FIG. 30M

```
Ser Ser Phe Ser Thr Ser His Tyr Thr Ser Thr Ala His His Ser Thr
AGC TCT TTT TCC ACC AGT CAC TAC ACT TCG ACA GCT CAT CAT TCC ACT
||| ||  ||| ||| ||| ||| ||| ||  ||| ||  ||| ||| ||| ||| ||| |||
ACA TCC TTT TCC ACC AGT CAC TAT ACT TCC ACA GCC CAT CAC TCC ACT            336
  T

Thr Val Thr Gln Thr Pro Ser His Ser Val Ile Val Met Ser Val Glu
ACT GTC ACT CAG ACT CCC AGT CAC TCT GTC ATC GTG ATG AGC ACT GAA
||| ||| ||| ||| ||| ||  ||  ||| ||| ||  ||| ||| ||| ||  ||| |||
ACT GTC ACC CAG ACT CCT AGC CAC AGC GTA ATC GTG ATG AGC ACT GAA            384

Ser Ile Ile Ser Glu Ser His Ser Pro Thr Gly Gly Pro Arg Gly Arg Leu Asn
AGC ATC ATT TCG GAA AGC CAC TCT GTG ATG AGC ACT GGG CCG AGA GGA CGT CTC AAT
||| ||| ||  ||  ||| ||| ||| ||| ||  ||| ||| ||| ||| ||  ||  ||  ||| ||  |||
AGC ATC CTT TCC GAA AGC CAC TCT GTA ATG AGC ACT GGG CCA AGA GGA CGT GTA AAT   432
          L

Asn Ser Arg His Ser Ser Pro Thr Gly Gly Pro Arg Gly Arg Leu Asn His Ala Arg
AAC AGT AGG CAC AGC AGC CCG ACT GGG GGC CCG AGA GGA CGT CTC AAT CAT GCC AGA
||| ||  ||| ||| ||| ||  ||  ||  ||| ||| ||  ||  ||  ||| ||  ||| ||| ||| |||
AAC AGT AGG CAC AGC AGC CCA ACT GGG GGC CCA AGA GGA CGT CTT AAT CAT GCC AGA   480

Gly Leu Gly Gly Pro Arg Glu Cys Asn Ser Phe Leu Arg His Ala Arg
GGC TTG GGA GGC CCT CGT GAA TGT AAC AGC TTC CTC AGG CAT GCC AGA
||    || ||| ||| ||  ||| ||| ||| ||| ||| ||  ||  ||| ||| ||| |||
GGC ACA GGA GGC CCT CGT GAA TGT AAC AGC TTC CTC AGG CAT GCC AGA            528
    T

Glu Thr Pro Asp Ser Tyr Arg Asp Ser Pro His Ser Glu Arg
GAA ACC CCT GAC TCC TAC CGA GAC TCT CCT CAT AGT GAA AG
||| ||| ||| ||  ||| ||| ||| ||| ||| ||| ||| ||| ||| ||
GAA ACC CCT GAT TCC TAC CGA GAC TCT CCT CAT AGT GAA AG             569
```

FIG. 30N

CODING SEGMENT K: (bovine)

```
(SEQ ID NO: 161)  A CAT AAC CTT ATA GCT GAG CTA AGG AGA AAC AAG GCC CAC AGA TCC    46
(SEQ ID NO: 412)    His Asn Leu Ile Ala Glu Leu Arg Arg Asn Lys Ala His Arg Ser

AAA TGC ATG CAG ATC CAG CTT TCC GCA ACT CAT CTT AGA GCT TCT TCC   94
                  Lys Cys Met Gln Ile Gln Leu Ser Ala Thr His Leu Arg Ala Ser Ser

ATT CCC CAT TGG GCT TCA TTC TCT AAG ACC CCT TGG CCT TTA GGA AG   141
                  Ile Pro His Trp Ala Ser Phe Ser Lys Thr Pro Trp Pro Leu Gly Arg
```

FIG. 30O (SEQ ID NO: 399)
(SEQ ID NO: 147)

(SEQ ID NO: 77)
(SEQ ID NO: 413)

CODING SEGMENT L: (bovine, top; human, bottom)

```
    Tyr Val Ser Ala Met Thr Pro Ala Arg Met Ser Pro Val Asp
  G TAT GTA TCA GCA ATG ACC CCG GCT CGT ATG TCA CCT GTA GAT      46
    ||| ||| ||  ||| ||| ||  ||| ||| ||| ||| ||| ||| ||| |||
  G TAT GTG TCA GCC ATG ACC CCG GCT CGT ATG TCA CCT GTA GAT

Phe His Thr Pro Ser Ser Pro Lys Ser Pro Pro Ser Glu Met Ser Pro
  TTC CAC ACG CCA AGC TCC CCC AAG TCA CCC CCT TCG GAA ATG TCC CCG      94
  ||| ||| ||  ||  ||| ||  ||| ||  ||  ||| ||| ||| ||| ||| ||  ||
  TTC CAC ACG CCA AGC TCC CCC AAA TCG CCC CCT TCG GAA ATG TCT CCA

Pro Val Ser Ser Thr Thr Val Ser Met Pro Ser Met Ala Val Ser Pro
  CCC GTG TCC AGC ACG ACG GTC TCC ATG CCC TCC ATG GCG GTC AGT CCC      142
  ||| ||| ||  ||| ||  ||  ||| ||| ||| ||| ||  ||| ||  ||| ||  |||
  CCC GTG TCC AGC ACG ACG GTG TCC ATG CCT TCC ATG GCG GTC AGC CCC
                       M

Phe Val Glu Glu Arg Pro Leu Leu Leu Val Thr Pro Pro Arg Leu
  TTC GTG GAA GAG AGA CCT CTG CTC CTT GTG ACG CCA CCA CGG CTG      190
  ||| ||| ||| ||| ||  ||  ||  ||  ||| ||  ||  ||| ||| ||  |||
  TTC ATG GAA GAA GAG CCT CTA CTT CTC GTG ACA CCA CCA AGG CTG
      M

Arg Glu Lys   —   Tyr Asp His His Ala Gln Gln Phe Asn Ser Phe His
  CGG GAG AAG ...   TAT GAC CAC CAC GCC CAG CAA TTC AAC TCG TTC CAC      238
  ||| ||| |||       ||  ||| ||  ||  ||  ||  ||  ||| ||  ||  ||| |||
  CGG GAG AAG AAG   TTT GAC CAT CAC CAT GCC CAG CAG TTC AGC TCC TTC CAC
                K    F                          P             S

Cys Asn Pro Ala His Glu Ser Asn Ser Leu Pro Ser Pro Leu Arg
  TGC AAC CCC GCG CAT GAG AGC AAC AGC CTG CCC AGC CCC TTG AGG      286
  ||  ||| ||| |   ||  ||  ||  ||| ||  ||  ||  ||| ||  ||  |||
  CAC AAC CCC GCG CAT GAC AGT AAC AGC CTC AGC AGC CCT GCT AGG
   H                  D                              A
```

FIG. 30P

```
     Ile Val Glu Asp Glu Glu Tyr Glu Thr Gln Glu Tyr Glu Pro Ala
     ATA GTG GAG GAT GAG GAA TAT GAA ACG CAG GAG TAC GAA CCA GCT
     ||| ||| ||| ||| ||| ||  ||| ||| ||| ||| ||| ||| ||| ||| ||
     ATA GTG GAG GAT GAG GAG TAT GAA ACG CAA GAG TAC GAG CCA GCC   334

Gln Glu Pro Val Lys Lys Leu Thr Asn Ser Ser Arg Arg Ala Lys Arg
     CAA GAG CCG GTT AAG AAA CTC ACC AAC AGC AGC CGG CGG GCC AAA AGA
     ||| ||| ||| ||| ||| ||| ||| ||  ||| |||         ||| ||| ||| |||
     CAA GAG CCT GTT AAG AAA CTC AA. ..T AGC         CGG GCC AAA AGA   382
                                    A

Thr Lys Pro Asn Gly His Ile Ala His Arg Leu Glu Met Asp Asn Asn
     ACC AAG CCC AAT GGT CAC ATT GCC CAC AGG TTG GAA ATG GAC AAC AAC
     ||| ||| ||| ||| ||| ||| ||| ||| ||| ||| ||  ||| || | ||| ||  |||
     ACC AAG CCC AAT GGC CAC ATT GCT AAC AGA TTG GAA GTG GAC AGC AAC   430
                                     N                    V       S

Thr Gly Ala Asp Ser Ser Asn Ser Glu Ser Glu Thr Glu Asp Glu Arg
     ACA GGC GCT GAC AGC AGT AAC TCA GAG AGC GAG ACA GAA GAT GAA AGA
     ||| ||  ||  ||| ||| ||| ||| ||| ||| ||| ||| ||| ||| ||| ||| |||
     ACA AGC TCC CAG AGC AGT AAC TCA GAG AGT GAG ACA GAA GAT GAA AGA   478
         S   S   Q
```

FIG. 30Q

```
Val Gly Glu Asp Thr Pro Phe Leu Ala Ile Gln Asn Pro Leu Ala Ala
GTA GGA GAA GAT ACG CCT TTC CTG GCC ATA CAG AAC CCC CTG GCA GCC      526
||| ||| ||| ||| ||| ||| ||| ||| ||| ||| ||| ||| ||| ||| ||| |||
GTA GGT GAA GAT ACG CCT TTC CTG GGC ATA CAG AAC CCC CTG GCA GCC
                                    G

Ser Leu Glu Ala Ala Pro Ala Phe Arg Leu Val Asp Ser Arg Thr Asn
AGT CTC GAG GCG GCC CCT GCC TTC CGC CTG GTC GAC AGC AGG ACT AAC      574
||| ||| ||| ||  ||| ||| ||| ||| ||| ||| ||| ||| ||| ||| ||| |||
AGT CTT GAG GCA GCA CCT GCC TTC CGC CTG GCT GAC AGC AGG ACT AAC
            T                           A

Pro Thr Gly Gly Phe Ser Pro Gln Glu Glu Leu Gln Ala Arg Leu Ser
CCA ACA GGC GGC TTC TCT CCG CAG GAA GAA TTG CAG GCC AGG CTC TCC      622
||| ||  ||| ||| ||| ||  ||| ||| ||| ||| ||| ||| ||| ||| ||| |||
CCA GCA GGC CGC TTC TCG ACA CAG GAA GAA CAG GCC AGG CTG TCT
        A           R           T                  I

Gly Val Ile Ala Asn Gln Asp Pro Ile Ala Val *
GGT GTA ATC GCT AAC CAA GAC CCT ATC GCT GTC TAA AAC CGA AAT ACA      670
||  ||| ||| ||| ||| ||| ||| ||| ||  ||| ||| ||| ||| ||  ||| |||
AGT GTA ATT GCT AAC CAA GAC CTT TAT GCT GTA TAA AAC CTA AAT AAA
  S

CCC ATA GAT TCA CCT GTA AAA CTT TAT TTT ATA TAA AGT ATT CCA           718
||| ||| ||| ||| ||| ||| ||| ||| ||| ||| ||| ||| ||| ||| |||
CAC ATA GAT TCA CCT GTA AAA CTT TAT TTT ATA TAA AGT ATT CCA

CCT TAA ATT AAA CAA                                                   733
||| ||| ||| ||| |||
CCT TAA ATT AAA CAA
```

(SEQ ID NO: 163)
(SEQ ID NO: 404)

HUMAN CODING SEGMENT E:

```
ATG AGA TGG CGA CGC GCC CCG CGC TCC GGG CGT CCC GGC CCC CGG      48
Met Arg Trp Arg Arg Ala Pro Arg Ser Gly Arg Pro Gly Pro Arg

GCC CAG CGC CCC GGC CTA TCC GCC CTG TCG CCG CCG CTG CCG CTG      96
Ala Gln Arg Pro Gly Leu Ser Ala Leu Ser Pro Pro Leu Pro Leu

CTG CCA CTG CTG CTG CTG CTG GGG GCC ACC CTG GCG CCG GGG GCG     144
Leu Pro Leu Leu Leu Leu Leu Gly Ala Thr Leu Ala Pro Gly Ala

GGC GCC GGC AAC GAG GAG GCT CCC GGG GCG GCC TCG GTG TAC TCG     192
Gly Ala Gly Asn Glu Glu Ala Pro Gly Ala Ala Ser Val Tyr Ser

TCC CCG CCC AGC GTG GGA TCG GAG CAG CTA GCT CAG CGC GCC GCG     240
Ser Pro Pro Ser Val Gly Ser Glu Gln Leu Ala Gln Arg Ala Ala

GTG GTG ATC GAG AAG AAG GTG CAC CCG CGG CAG CAG GGG GCA GCA     288
Val Val Ile Glu Lys Lys Val His Pro Arg Gln Gln Gly Ala Ala

CTC GAC AGG AAG GCG GCG GCG CCA CCG GCG GCG GGG GCG TGG GGC     336
Leu Asp Arg Lys Ala Ala Ala Pro Pro Ala Ala Gly Ala Trp Gly

GGC GAT CGC AGG GAG GAG CCG CTG CCC CGG AAC GGG GAG CCG CCC     384
Gly Asp Arg Arg Glu Glu Pro Leu Pro Arg Asn Gly Glu Pro Pro

GCC GCC GCC GAG GAG CCC GTG CTC CCC AGC GTG GCG ACC GTG TGG CCC CCC TCT TGG     432
Ala Ala Ala Glu Glu Pro Val Leu Pro Ser Ala Thr Val Trp Pro

ACC GCC CCG GGG GTG AAA GCC GAG GGG GGC TTG AAG     480
Thr Ala Pro Gly Val Lys Ala Glu Gly Gly Leu Lys

CTG GTG AAG GTG GTG CAG CGC CTG TGG GCC ACC TGG CAC CCC TAT     528
Leu Val Lys Val Val Gln Arg Leu Trp Ala Thr Trp His Pro Tyr

AAG GAC TCG CTC TCT ACC GAG GAG GAC CTG AGC AGG TAC ATC TTC AAG     576
Lys Asp Ser Leu Leu Thr Glu Glu Asp Leu Arg Arg Tyr Ile Lys

TTC CCC TGC TGC GAC GCC CTC AAG ACC AAC AGC GCC GCC TTC TTC     624
Phe Pro Ser Cys Asp Ala Leu Lys Thr Asn Ser Arg Ala Ala Phe

ATG GAG CCC CGC GAC GCC CCT CTG GAG CGG CCG CCG GCC AAG AAG GAG     672
Met Glu Pro Arg Asp Ala Pro Leu Glu Glu Arg Arg Ala Lys Lys

GCC TCT TTC CCC TGC TGC CTG GAG ACG CGG AAC CTC AAG GAG GTC     720
Ala Ser Phe Pro Pro Leu Leu Glu Thr Gly Arg Asn Leu Lys Glu Val

AGC CGG GTG CTG TGC AAG CGG TGC G     745
Ser Arg Val Leu Cys Lys Arg Cys
```

GGF2BPP5 Nucleotide Sequence & Deduced Protein Sequence

```
(SEQ ID NO: 148) AGTTTCCCCC CCCAACTTGT CGGAACTCTG GGCTCGCGCG CAGGGCAGGA GCGGAGCGGC    60
                 GGCGGCTGCC CAGGCGATGC GAGCGCGGGC CGGACGGTAA TCGCCCTCTCC CTCCTCGGGC   120
                 TGCGAGCGCG CCGGACCGAG GCAGCGACAG GAGCGGACCG CGGCGGGAAC CGAGGACTCC   180
                 CCAGCGGCGC GCCAGCAGGA GCCACCCCGC GAGNCGTGCG ACCGGACGG AGCGCCCGCC     240
                 AGTCCCAGGT GGCCCGGACC GCACGTTGCG TCCCCGCGCT CCCCGCCGGC GACAGGAGAC   300
                 GCTCCCCCCC ACGCCGCGCG CGCCTCGGCC CGGTCGCTGG CCCGCCTCCA CTCCGGGGAC   360
                 AAACTTTTCC CGAAGCCGAT CCCAGCCCTC GGACCCAAAC TTGTCGCGCG TCGCCTTCGC   420
                 CGGGAGCCGT CCGCGCAGAG CGTGCACTTC TCGGGCGAG ATG TCG GAG CGC AGA       475
                                                          Met Ser Glu Arg Arg (SEQ ID NO: 389)
                 GAA GGC AAA GGG AAG GGC GGC AAG AAG GAC CGA GGC TCC GGG              523
                 Glu Gly Lys Gly Lys Gly Gly Lys Lys Asp Arg Gly Ser Gly

AAG AAG CCC GTG CCC GCT GGC GGC AGC CCA GCC TTG CCT CCC              571
                 Lys Lys Pro Val Pro Ala Gly Gly Ser Pro Ala Leu Pro Pro

CGC TTG AAA GAG ATG CAG GAG TCT GTG GCA GGT TCC AAA CTA              619
                 Arg Leu Lys Glu Met Gln Glu Ser Val Ala Gly Ser Lys Leu

GTG CTT CGG TGC GAG ACC AGT TCT GAA TAC TCC TCT CTC AAG TTC AAG      667
                 Val Leu Arg Cys Glu Thr Ser Ser Glu Tyr Ser Ser Leu Lys Phe Lys

TGG TTC AAG AAT GGG AGT GAA TTA AGC CGA AAG AAC CCA CAA AAC          715
                 Trp Phe Lys Asn Gly Ser Glu Leu Ser Arg Lys Asn Pro Gln Asn

ATC AAG ATA CAG AAA AGG CCG GGG AAG TCA GAA CTT CGC ATT AGC AAA      763
                 Ile Lys Ile Gln Lys Arg Pro Gly Lys Ser Glu Leu Arg Ile Ser Lys

GCG TCA CTG GCT GAT TCT GGA GAA TAT ATG TGC AAA GTG ATC AGC AAA      811
                 Ala Ser Leu Ala Asp Ser Gly Glu Tyr Met Cys Lys Val Ile Ser Lys
```

FIG. 31B

GGF2BPP5 Nucleotide Sequence & Deduced Protein Sequence

```
CTA GGA AAT GAC AGT GCC TCT GCC AAC ATC ACC ATT GTG GAG TCA AAC      859
Leu Gly Asn Asp Ser Ala Ser Ala Asn Ile Thr Ile Val Glu Ser Asn

GAG ATC ACT ACT GGC ATG CCA GCC TCA ACT GAG ACA GCG TAT GTG TCT      907
Glu Ile Thr Thr Gly Met Pro Ala Ser Thr Glu Thr Ala Tyr Val Ser

TCA GAG TCT CCC ATT AGA ATA TCA GTA TCA GAA GGA ACA AAT ACT          955
Ser Glu Ser Pro Ile Arg Ile Ser Val Ser Glu Gly Thr Asn Thr

TCT TCA TCC ACA TCC ACA TCT ACA GCT GGG ACA AGC CAT CTT GTC AAG     1003
Ser Ser Ser Thr Ser Thr Ser Thr Ala Gly Thr Ser His Leu Val Lys

TGT GCA GAG AAG GAG AAA ACT TTC TGT GTG AAT GGA GGC GAG TGC TTC     1051
Cys Ala Glu Lys Glu Lys Thr Phe Cys Val Asn Gly Gly Glu Cys Phe

ATG GTG AAA GAC CTT TCA AAT CCC TCA AGA TAC TTG TGC AAG TGC CCA     1099
Met Val Lys Asp Leu Ser Asn Pro Ser Arg Tyr Leu Cys Lys Cys Pro

AAT GAG TTT ACT GGT GAT CGC TGC CAA AAC TAC GTA ATG GCC AGC TTC     1147
Asn Glu Phe Thr Gly Asp Arg Cys Gln Asn Tyr Val Met Ala Ser Phe

TAC AGT ACG TCC ACT CCC TTT CTG TCT CCT GAA TAGGCGCATG              1193
Tyr Ser Thr Ser Thr Pro Phe Leu Ser Pro Glu

CTCAGTCGGT GCCGCTTTCT TGTTGCCGCA TCTCCCCTCA GATTCAACCT AGAGCTAGAT    1253
GCGTTTTACC AGTCTAACA TTGACTGCCT CTGCCTGTCG CATGAGAACA TTAACACAAG     1313
CGATTGTATG ACTTCCTCTG TCCGTGACTA GTGGGCTCTG AGCTACTCGT AGGTGCGTAA    1373
GGCTCCAGTG TTTCTGAAAT TGATCTTGAA TTACTGTGAT ACGACATGAT AGTCCCTCTC    1433
ACCCAGTGCA ATGACAATAA AGGCCTTGAA AAGTCTCACT TTTATTGAGA AAATAAAAAT    1493
CGTTCCACGG GACAGTCCCT CTTCTTTATA AAATGACCCT ATCCTTGAAA AGGAGGTGTG    1553
TTAAGTTGTA ACCAGTACAC ACTTGAAATG ATGGTAAGTT CGCTTCGGTT CAGAATGTGT    1613
TCTTTCTGAC AAATAAACAG AATAAAAAAA AAAAAAAAA A                         1654
```

FIG. 32A

GGF2BPP2 Nucleotide Sequence & Deduced Protein Sequence (SEQ ID NO: 149)
(SEQ ID NO: 386)

```
CAT CAN GTG GCG GGG AAA GCC GGG GGC TTG AAG GAC TCG CTG    48
His Gln Val Ala Gly Lys Ala Gly Gly Leu Lys Asp Ser Leu

CTC ACC GTG CGC CTG GGC CTG GGC CAC CCC GCC TTC CCC TCC TGC    96
Leu Thr Val Arg Leu Gly Leu Gly His Pro Ala Phe Pro Ser Cys

GGG CGC CTC AAG GAG GAC AGC AGG TAC ATC TTC ATG GAG CCC GAG   144
Gly Arg Leu Lys Glu Asp Ser Arg Tyr Ile Phe Met Glu Pro Glu

GCC AAC AGC AGC GGG CCC GGC CTT CCG AGC CTC CTT CCC CCC   192
Ala Asn Ser Ser Gly Pro Gly Leu Pro Ser Leu Leu Pro Pro

TCT CGA GAC GGG CCG GAA CCT CAA GGA GGT CAG CCG GGT GCT GTG   240
Ser Arg Asp Gly Pro Glu Pro Gln Glu Gly Gly Gln Pro Gly Ala Val

CAA CGG TGC GCC TTG CCT CCC CGC TTG AAA GAG ATG AAG CAG GAG   288
Gln Arg Cys Ala Leu Pro Pro Arg Leu Lys Glu Met Lys Ser Gln Glu

TCT GTG GCA GGT TCC AAA CTA GTG CTT CGG CTT CTT CGG ACC AGT TCT GAA   336
Ser Val Ala Gly Ser Lys Leu Val Leu Arg Cys Glu Thr Ser Ser Glu

TAC TCC TCT CTC AAG TTC AAG TGG TTC AAG AAT GGG AGT GAA TTA AGC   384
Tyr Ser Ser Leu Lys Phe Lys Trp Phe Lys Asn Gly Ser Glu Leu Ser

CGA AAG AAC AAA CCA GAA AAC ATC AAG ATA CAG ATA AAA AGG CCG GGG AAG   432
Arg Lys Asn Lys Pro Glu Asn Ile Lys Ile Gln Ile Lys Arg Pro Gly Lys

TCA GAA CTT CGC ATT AGC TCA CTG GCT GAT TCT GGA GAA TAT   480
Ser Glu Leu Arg Ile Ser Lys Ala Ser Leu Ala Asp Ser Gly Glu Tyr

ATG TGC AAA GTG ATC AGC AAA CTA GGA AAT GAC AGT TCT GCC AAC   528
Met Cys Lys Val Ile Ser Lys Leu Gly Asn Asp Ser Ser Ala Asn
```

FIG. 32B

GGF2BPP2 Nucleotide Sequence & Deduced Protein Sequence

```
ATC ACC ATT GTG GAG TCA AAC GCC ACA TCC ACA TCT ACA GCT GGG ACA      576
Ile Thr Ile Val Glu Ser Asn Ala Thr Ser Thr Ser Thr Ala Gly Thr

AGC CAT CTT GTC AAG TGT GCA GAG AAG GAG AAA ACT TTC TGT GTG AAT      624
Ser His Leu Val Lys Cys Ala Glu Lys Glu Lys Thr Phe Cys Val Asn

GGA GGC GAG TGC TTC ATG GTG AAA GAC CTT TCA AAT CCC TCA AGA TAC      672
Gly Gly Glu Cys Phe Met Val Lys Asp Leu Ser Asn Pro Ser Arg Tyr

TTG TGC AAG TGC CAA CCT GGA TTC ACT GGA GCG AGA TGT ACT GAG AAT      720
Leu Cys Lys Cys Gln Pro Gly Phe Thr Gly Ala Arg Cys Thr Glu Asn

GTG CCC ATG AAA GTC CAA ACC CAA GAA AAG TGC CCA AAT GAG TTT ACT      768
Val Pro Met Lys Val Gln Thr Gln Glu Lys Cys Pro Asn Glu Phe Thr

GGT GAT CGC TGC CAA AAC TAC GTA ATG GCC TTC TAC AGT ACG TCC          816
Gly Asp Arg Cys Gln Asn Tyr Val Met Ala Ser Phe Tyr Ser Thr Ser

ACT CCC TTT CTG TCT CTG CCT GAA TAGCGCATCT CAGTCGGTGC CGCTTTCTTG     870
Thr Pro Phe Leu Ser Leu Pro Glu

TTGCCGCATC TCCCCCTCAGA TTCCNCCTAG AGCTAGATGC GTTTTACCAG GTCTAACATT    930

GACTGCCTCT GCCTGTCGCA TGAGAACATT AACACAAGCG ATTGTATGAC TTCCCTCTGTC   990

CGTGACTAGT GGGCTCTGAG CTACTCGTAG GTGCGTAAGG CTCCAGTGTT TCTGAAATTG   1050

ATCTTGAATT ACTGTGATAC GACATGATAG TCCCTCTCAC CCAGTGCAAT GACAATAAAG   1110

GCCTTGAAAA GTCAAAAAAA AAAAAAAAAA                                   1140
```

GGF2BPP4 Nucleotide Sequence & Deduced Protein Sequence (SEQ ID NO: 150)
(SEQ ID NO: 388)

```
  G AAG TCA GAA CTT CGC ATT AGC AAA GCG TCA GCT GAT TCT GGA GAA    49
    Lys Ser Glu Leu Arg Ile Ser Lys Ala Ser Leu Ala Asp Ser Gly Glu

TAT ATG TGC AAA GTG ATC AGC AAA CTA GGA AAT AGT GCC TCT GCC         97
Tyr Met Cys Lys Val Ile Ser Lys Leu Gly Asn Ser Ala Ser Ala

AAC ATC ACC ATT GTG GAG TCA AAC GCC ACA TCC ACA TCT ACA GCT GGG    145
Asn Ile Thr Ile Val Glu Ser Asn Ala Thr Ser Thr Ser Thr Ala Gly

ACA AGC CAT CTT GTC AAG GAG TGT GCA GAG AAG GAG AAA ACT TTC TGT GTG  193
Thr Ser His Leu Val Lys Glu Cys Ala Glu Lys Glu Lys Thr Phe Cys Val

AAT GGA GGC GAC TGC TTC ATG GTG AAA GAC CTT TCA AAT CCC TCA AGA    241
Asn Gly Gly Asp Cys Phe Met Val Lys Asp Leu Ser Asn Pro Ser Arg

TAC TTG TGC AAG TGC CAA CCT GGA TTC ACT GGA GCG AGA TGT ACT GAG    289
Tyr Leu Cys Lys Cys Gln Pro Gly Phe Thr Gly Ala Arg Cys Thr Glu

AAT GTG CCC ATG AAA GTC CAA ACC CAA GAA AAA GCG GAG CTC GTG TAC    337
Asn Val Pro Met Lys Val Gln Thr Gln Glu Lys Ala Glu Leu Val Tyr

CAG AAG AGA GTG CTC ACC ATT ACC GGC ATT TGC ATC GCG CTG CTC GTG    385
Gln Lys Arg Val Leu Thr Ile Thr Gly Ile Cys Ile Ala Leu Leu Val

GTT GGC ATC ATG TGT GTG GTC TAC TGC AAA ACC AAG AAA CAA CGG        433
Val Gly Ile Met Cys Val Val Tyr Cys Lys Thr Lys Lys Gln Arg

AAA AAG CTT CAT GAC CTT CGG CAG AGC CTT CGG TCT GAA AGA AAC        481
Lys Lys Leu His Asp Leu Arg Gln Ser Leu Arg Ser Glu Arg Asn

ACC ATG ATG AAC GTA GCC AAC GGG CCC CAC CAC AAT CCG CCC CCC        529
Thr Met Met Asn Val Ala Asn Gly Pro His His Asn Pro Pro Pro

GAG AAC GTG CAG CTG GTG AAT CAA TAC GTA TCT AAA AAT GTC ATC TCT    577
Glu Asn Val Gln Leu Val Asn Gln Tyr Val Ser Lys Asn Val Ile Ser
```

GGF2BPP4 Nucleotide Sequence & Deduced Protein Sequence

```
AGC GAG CAT ATT GAG AGA GAG GCG GAG AGC TCT TTT TCC ACC AGT      625
Ser Glu His Ile Val Glu Arg Ala Glu Ser Ser Phe Ser Thr Ser

CAC TAC ACT TCG ACA GCT CAT CAT TCC ACT GTC ACT CAG ACT CCC      673
His Tyr Thr Ser Thr Ala His His Ser Thr Val Thr Gln Thr Pro

AGT CAC AGC TGG AGC AAT GGA CAC AGC ACT GAA AGC ATT TCG GAA AGC  721
Ser His Ser Trp Ser Asn Gly His Ser Thr Glu Ser Ile Ser Glu Ser

CAC TCT GTC ATC GTG ATG TCA TCC GTA GAA AAC AGT GTA CAC AGC AGC  769
His Ser Val Ile Val Met Ser Ser Val Glu Asn Ser Val His Ser Ser

CCG ACT GGG GGC CCG AGA CGT CTC AAT GGC TTG GGA GGC CCT CGT      817
Pro Thr Gly Gly Pro Arg Arg Leu Asn Gly Leu Gly Gly Pro Arg

GAA TGT AAC AGC TTC CTC AGG CAT GCC AGA GAA ACC CCT GAC TCC TAC  865
Glu Cys Asn Ser Phe Leu Arg His Ala Arg Glu Thr Pro Asp Ser Tyr

CGA GAC TCT CCT CAT AGT GAA CAT AAC CTT ATA GCT GAG CTA CTA AGG  913
Arg Asp Ser Pro His Ser Glu His Asn Leu Ile Ala Glu Leu Leu Arg

AGA AAC AAG GCC AGA CAC TCC AAA TGC ATG CAG ATC CAG CTT TCC GCA  961
Arg Asn Lys Ala Arg His Ser Lys Cys Met Gln Ile Gln Leu Ser Ala

ACT CAT CTT AGA GCT TCT CCC ATT CCC CAT TGG GCT TCA TCT AAG     1009
Thr His Leu Arg Ala Ser Ile Pro His Trp Ala Ser Phe Ser Lys

ACC CCT TGG CCT TTA GGA TAT GTA TCA GCA ATG ACC ACC CCG GCT     1057
Thr Pro Trp Pro Leu Gly Tyr Val Ser Ala Met Thr Thr Pro Ala

CGT ATG TCA CCT GTA GAT TTC CAC ACG CCA CAC TCC AAG TCA CCC     1105
Arg Met Ser Pro Val Asp Phe His Thr Pro Ser Pro Lys Ser Pro

CCT TCG GAA ATG TCC CCG GTG TCC AGC ACG GTC TCC ATG CCC         1153
Pro Ser Glu Met Ser Pro Val Pro Ser Ser Thr Val Ser Met Pro
```

FIG. 33C

GGF2BPP4 Nucleotide Sequence & Deduced Protein Sequence

```
TCC ATG GCG GTC AGT CCC TTC GTG GAA GAG GAG AGA CCC CTG CTC CTT    1201
Ser Met Ala Val Ser Pro Phe Val Glu Glu Glu Arg Pro Leu Leu Leu

GTG ACG CCA CCA CGG CTG CGG GAG AAG TAT GAC CAC CAC GCC CAG CAA    1249
Val Thr Pro Pro Arg Leu Arg Glu Lys Tyr Asp His His Ala Gln Gln

TTC AAC TCG TTC CAC TGC AAC CCC GCG CAT GAG AGC AAC AGC CTG CCC    1297
Phe Asn Ser Phe His Cys Asn Pro Ala His Glu Ser Asn Ser Leu Pro

CCC AGC CCC TTG AGG ATA GTG GAG GAT GAG GAA TAT GAA ACG ACC CAG    1345
Pro Ser Pro Leu Arg Ile Val Glu Asp Glu Glu Tyr Glu Thr Thr Gln

GAG TAC GAA CCA GCT CAA GAG CCG GTT AAG AAA CTC ACC AAC AGC AGC    1393
Glu Tyr Glu Pro Ala Gln Glu Pro Val Lys Lys Leu Thr Asn Ser Ser

CGG CGG GCC AAA AGA ACC AAG CCC AAT GGT CAC ATT GCC CAC AGG TTG    1441
Arg Arg Ala Lys Arg Thr Lys Pro Asn Gly His Ile Ala His Arg Leu

GAA ATG GAC AAC AAC ACA GGC GCT GAC AGT AAC TCA GAG AGC GAA        1489
Glu Met Asp Asn Asn Thr Gly Ala Asp Ser Ser Asn Ser Glu Glu

ACA GAG GAT GAA AGA GTA GGA GAA GAT ACG GAG CCT TTC CTG GCC ATA CAG    1537
Thr Glu Asp Glu Arg Val Gly Glu Asp Thr Glu Pro Phe Leu Ala Ile Gln

AAC CCC CTG GCA GCC AGT CTC GAG CTG GCG GCC CCT GCC TTC CGC CTG GTC    1585
Asn Pro Leu Ala Ala Ser Leu Glu Leu Ala Ala Pro Ala Phe Arg Leu Val

GAC AGC AGG ACT AAC CCA ACA GGC GGC TTC TCT CCG CAG GAA GAA TTG    1633
Asp Ser Arg Thr Asn Pro Thr Gly Gly Phe Ser Pro Gln Glu Glu Leu

CAG GCC AGG CTC TCC GGT GTA ATC GCT AAC CAA GAC CCT ATC GCT GTC    1681
Gln Ala Arg Leu Ser Gly Val Ile Ala Asn Gln Asp Pro Ile Ala Val

TAAAACCGAA ATACACCCAT AGATTCACCT GTAAAACTTT ATTTTATATA ATAAAGTATT   1741

CCACCTTAAA TTAAACAAAA AAA                                           1764
```

FIG. 34

```
GGF2bpp5 (SEQ ID NO: 151)  KCAEKEKTFCVNGGECFMVKDLSNPSRYLCKCPNEFTGDRCQNYVMASFY
GGF2bpp4 (SEQ ID NO: 152)  KCAEKEKTFCVNGGDCFMVKDLSNPSRYLCKCQPGFTGARCTENVPMKVQ
hEGF     (SEQ ID NO: 153)  ECLRKYKDFCIH-GECKYVKELRAPS---CKCQQEYFGERCGEKSNKTHS
```

200 kDa Tyrosine Phosphorylation Compared with Mitogenic Activity

FIG. 36A

GGF/Heregulin Splicing Variants

GGF/Heregulin Splicing Variants

EGFL1

(SEQ ID NO: 154)
(SEQ ID NO: 414)

```
AGC CAT CTT GTC AAG TGT GCA GAG AAG GAG AAA ACT TTC TGT GTG AAT      48
Ser His Leu Val Lys Cys Ala Glu Lys Glu Lys Thr Phe Cys Val Asn

GGA GGC GAG TGC TTC ATG GTG AAA GAC CTT TCA AAT CCC TCA AGA TAC      96
Gly Gly Glu Cys Phe Met Val Lys Asp Leu Ser Asn Pro Ser Arg Tyr

TTG TGC AAG TGC CCA AAT GAG TTT ACT GGT GAT CGC TGC CAA AAC TAC     144
Leu Cys Lys Cys Pro Asn Glu Phe Thr Gly Asp Arg Cys Gln Asn Tyr

GTA ATG GCC AGC TTC TAC AGT TCC ACG TCC ACT CCC TTT CTG TCT CTG CCT 192
Val Met Ala Ser Phe Tyr Ser Thr Ser Thr Pro Phe Leu Ser Leu Pro

GAA TAG                                                             198
Glu
```

FIG. 38

EGFL2

```
(SEQ ID NO: 155)  AGC CAT CTT GTC AAG TGT GCA GAG AAG GAG AAA ACT TTC TGT GTG AAT    48
(SEQ ID NO: 415)  Ser His Leu Val Lys Cys Ala Glu Lys Glu Lys Thr Phe Cys Val Asn

GGA GGC GAG TGC TTC ATG GTG AAA GAC CTT TCA AAT CCC TCA AGA TAC    96
                  Gly Gly Glu Cys Phe Met Val Lys Asp Leu Ser Asn Pro Ser Arg Tyr

TTG TGC AAG TGC CAA CCT GGA TTC GGA TTC ACT GGA AGA TGT ACT GAG AAT  144
                  Leu Cys Lys Cys Gln Pro Gly Phe Gly Phe Thr Gly Arg Cys Thr Glu Asn

GTG CCC ATG AAA GTC CAA ACC CAA GAA AAA GCG GAG GAG CTC TAC TAA    192
                  Val Pro Met Lys Val Gln Thr Gln Glu Lys Ala Glu Glu Leu Tyr
```

FIG. 39

EGFL3

```
(SEQ ID NO: 156)
(SEQ ID NO: 416)
AGC CAT CTT GTC AAG TGT GCA GAG AAG GAG AAA ACT TTC TGT GTG AAT    48
Ser His Leu Val Lys Cys Ala Glu Lys Glu Lys Thr Phe Cys Val Asn

GGA GGC GAG TGC TTC ATG GTG AAA GAC CTT TCA AAT CCC TCA AGA TAC    96
Gly Gly Glu Cys Phe Met Val Lys Asp Leu Ser Asn Pro Ser Arg Tyr

TTG TGC AAG TGC CCA AAT GAG TTT ACT GGT GAT CGC TGC CAA AAC TAC    144
Leu Cys Lys Cys Pro Asn Glu Phe Thr Gly Asp Arg Cys Gln Asn Tyr

GTA ATG GCC AGC TTC TAC AAA GCG GAG GAG CTC TAC TAA               183
Val Met Ala Ser Phe Tyr Lys Ala Glu Glu Leu Tyr
```

FIG. 40

EGFL4

```
(SEQ ID NO: 157)  AGC CAT CTT GTC AAG TGT GCA GAG AAG GAG AAA ACT TTC TGT GTG AAT   48
(SEQ ID NO: 417)  Ser His Leu Val Lys Cys Ala Glu Lys Glu Lys Thr Phe Cys Val Asn

GGA GGC GAG TGC TTC ATG GTG AAA GAC CTT TCA AAT CCC TCA AGA TAC   96
                  Gly Gly Glu Cys Phe Met Val Lys Asp Leu Ser Asn Pro Ser Arg Tyr

TTG TGC AAG TGC CCA AAT GAG TTT ACT GGT GAT CGC TGC CAA AAC TAC  144
                  Leu Cys Lys Cys Pro Asn Glu Phe Thr Gly Asp Arg Cys Gln Asn Tyr

GTA ATG GCC AGC TTC TAC AAG CAT CTT GGG ATT GAA TTT ATG GAG AAA  192
                  Val Met Ala Ser Phe Tyr Lys His Leu Gly Ile Glu Phe Met Glu Lys

GCG GAG GAG CTC TAC TAA                                          210
                  Ala Glu Glu Leu Tyr
```

FIG. 41

EGFL5

(SEQ ID NO: 158)
(SEQ ID NO: 418)

```
AGC CAT CTT GTC AAG TGT GCA GAG AAG GAG AAA ACT TTC TGT GTG AAT    48
Ser His Leu Val Lys Cys Ala Glu Lys Glu Lys Thr Phe Cys Val Asn

GGA GGC GAG TGC TTC ATG GTG AAA GAC CTT TCA AAT CCC TCA AGA TAC    96
Gly Gly Glu Cys Phe Met Val Lys Asp Leu Ser Asn Pro Ser Arg Tyr

TTG TGC AAG TGC CAA CCT GGA TTC ACT GGA GCG AGA TGT ACT GAG AAT   144
Leu Cys Lys Cys Gln Pro Gly Phe Thr Gly Ala Arg Cys Thr Glu Asn

GTG CCC ATG AAA GTC CAA ACC CAA GAA AAG TGC CCA AAT GAG TTT ACT   192
Val Pro Met Lys Val Gln Thr Gln Glu Lys Cys Pro Asn Glu Phe Thr

GGT GAT CGC TGC CAA AAC TAC GTA ATG GCC AGC TTC TAC AGT ACG TCC   240
Gly Asp Arg Cys Gln Asn Tyr Val Met Ala Ser Phe Tyr Ser Thr Ser

ACT CCC TTT CTG TCT CTG CCT GAA TAG                                267
Thr Pro Phe Leu Ser Leu Pro Glu
```

FIG. 42

EGFL6

```
(SEQ ID NO: 159)
(SEQ ID NO: 419)  AGC CAT CTT GTC AAG TGT GCA GAG AAG GAG AAA ACT TTC TGT GTG AAT    48
                  Ser His Leu Val Lys Cys Ala Glu Lys Glu Lys Thr Phe Cys Val Asn

GGA GGC GAG TGC TTC ATG GTG AAA GAC CTT TCA AAT CCC TCA AGA TAC    96
                  Gly Gly Glu Cys Phe Met Val Lys Asp Leu Ser Asn Pro Ser Arg Tyr

TTG TGC AAG TGC CAA CCT GGA TTC ACT GGA GCG AGA TGT ACT GAG AAT    144
                  Leu Cys Lys Cys Gln Pro Gly Phe Thr Gly Ala Arg Cys Thr Glu Asn

GTG CCC ATG AAA GTC CAA ACC CAA GAA AAG TGC CCA AAT GAG TTT ACT    192
                  Val Pro Met Lys Val Gln Thr Gln Glu Lys Cys Pro Asn Glu Phe Thr

GGT GAT CGC TGC CAA AAC TAC GTA ATG GCC TTC TAC AAA GCG GAG          240
                  Gly Asp Arg Cys Gln Asn Tyr Val Met Ala Ser Phe Tyr Lys Ala Glu

GAG CTC TAC TAA                                                     252
                  Glu Leu Tyr
```

GGF2HBS5

FIG. 44A

Nucleotide Sequence & Deduced Amino Acid Sequence of GGF2HBS5

```
(SEQ ID NO: 21) GGAATTCCTT TTTTTTTTT TTTTTTTCTT NNTTTTTTT TGCCCTTATA CCTCTTCGCC      60
                TTTCTGTGGT TCCATCCACT TCTTCCCCCT CCTCCTCCCA TAAACAACTC TCCTACCCCT     120
                GCACCCCCAA TAAATAAATA AAAGGAGGAG GGCAAGGGGG GAGGAGGAGG AGTGGTGCTG     180
                CGAGGGGAAG GAAAAGGGAG GCAGCGCGAG AAGAGCCGGG CAGAGTCCGA ACCGACAGCC     240
                AGAAGCCCGC ACGCACCTCG CACC ATG AGA TGG CGA CGC GCC CGC CGC                291
                               Met Arg Trp Arg Arg Ala Pro Arg Arg
(SEQ ID NO: 170)
TCC GGG CGT CCC CCG GGC CTG CCG CTG CTG CCA CTA CTG CCC CTG CTC CGC CGC           339
Ser Gly Arg Pro Pro Gly Leu Pro Leu Leu Pro Leu Leu Pro Leu Ala Arg
                                                      (SEQ ID NO: 50)GGF-II 09

TCG CCG CCG CTG GCG CCG GGG GCG GCG GCC GGC AAC GAG GCG GCT CCC GCG              387
Ser Pro Pro Leu Ala Pro Gly Ala Ala Ala Gly Asn Glu Ala Ala Pro Ala

GCG GCC CTG GCG CTG GCT CAG CGC GCC GTG GTG ATC GAG GGA AAG GTG CAC CCG          435
Ala Ala Leu Ala Leu Ala Gln Arg Ala Val Val Ile Glu Gly Lys Val His Pro
                                                      (SEQ ID NO: 49)GGF-II 08

GGG GCC TCG GTG TGC TAC TCG TCC CCG AGC GTG GGA TCG GTG CAG              483
Gly Ala Ser Val Cys Tyr Ser Ser Pro Ser Val Gly Ser Val Gln
                    Ala Ser Pro Val Ser Val Gly Ser Val Gln
                    (SEQ ID NO: 48)GGF-II 04

GAG CTA GCT CAG CGC GCC GTG GTG ATC GAG GGA AAG GTG CAC CCG              531
Glu Leu Ala Gln Arg Ala Val Val Ile Glu Gly Lys Val His Pro
Glu Leu Val Gln Arg Trp Phe Val Val Ile Glu Gly Lys
```

FIG. 44B

Nucleotide Sequence & Deduced Amino Acid Sequence of GGF2HBS5

```
CAG CGG CAG CAG GGG GCA CTC GAC AGG AAG GCG GCG GCG GCG GCG       579
Gln Arg Gln Gln Gly Ala Leu Asp Arg Lys Ala Ala Ala Ala Ala

GGC GAG GCA GGG GCG TGG GGC GAT CGC GAG CCA GCC GCG GGC           627
Gly Glu Ala Gly Ala Trp Gly Gly Asp Arg Glu Pro Pro Ala Gly

CCA CGG GCG CTG GGG CCG CCC GAG GAG CCG CTG CGC GCC AAC           675
Pro Arg Ala Leu Gly Pro Pro Ala Glu Glu Pro Leu Leu Ala Asn

GGG ACC GTG CCC TCT TGG CCC ACC GCC CCG GTG CCC AGC GGC GAG       723
Gly Thr Val Pro Ser Trp Pro Thr Ala Pro Val Pro Ser Ala Gly Glu

CCC GGG GAG GAG GCG CCC TAT CTG GTG AAG GTG CAC CAG GTG TGG GCG   771
Pro Gly Glu Glu Ala Pro Tyr Leu Val Lys Val His Gln Val Trp Ala
                                      Lys Val His Gln Val Trp Ala
                   (SEQ ID NO: 45 & NO: 51) GGF-II 01 & GGF-II 11

GTG AAA GCC GGG GGC TTG AAG AAG GAC TCG CTG CTC ACC GTG CGC CTG   819
Val Lys Ala Gly Gly Leu Lys Lys Asp Ser Leu Leu Thr Val Arg Leu
                                Asp Leu Leu Leu Xaa Val     Leu
                   (SEQ ID NO: 53) GGF-II 10

GGG ACC TGG GGC CAC CCC GCC TTC CCC TCC TGC GGG AGG CTC AAG GAG   867
Gly Thr Trp Gly His Pro Ala Phe Pro Ser Cys Gly Arg Leu Lys Glu
Gly Ala Trp Gly Pro Pro Ala Phe Pro Val Xaa Tyr
(SEQ ID NO: 47) GGF-II 03

GAC AGC AGG TAC ATC TTC TTC ATG GAG CCC GAC GCC AAC AGC ACC AGC   915
Asp Ser Arg Tyr Ile Phe Phe Met Glu Pro Asp Ala Asn Ser Thr Ser
Tyr Ile Phe Phe Met Glu Pro Glu Ala Xaa Ser Ser Gly
         (SEQ ID NO: 46) GGF-II 02
```

FIG. 44C

Nucleotide Sequence & Deduced Amino Acid Sequence of GGF2HBS5

```
CGC GCG CCG GCC TTC CGA GCC TCT TTC CCC CCT CTG GAG ACG GGC      963
Arg Ala Pro Ala Phe Arg Ala Ser Phe Pro Pro Leu Glu Thr Gly

CGG AAC CTC AAG AAG GAG GTC AGC CGG GTG TGC AAG CGG TGC GCC     1011
Arg Asn Leu Lys Lys Glu Val Ser Arg Val Cys Lys Arg Cys Ala

TTG CCT CCC CAA AAA GAG ATG TTG GAA AGC CAG GAA TCG GCT GCA GGT 1059
Leu Pro Pro Gln Lys Glu Met Lys Ser Gln Glu Ser Ala Ala Gly

TCC AAA CTA GTC CTT CGG TGT GAA ACC AGT TCT GAA TAC TCC TCT CTC 1107
Ser Lys Leu Val Leu Arg Cys Glu Thr Ser Ser Glu Tyr Ser Ser Leu
        Leu Val Leu Arg
        (SEQ ID NO: 42) GGF-II 06

AGA TTC AAG TGG TTC AAG AAT GGG AAT GAA TTG AAT CGA AAA AAC AAA 1155
Arg Phe Lys Trp Phe Lys Asn Gly Asn Glu Leu Asn Arg Lys Asn Lys

CCA CAA AAT ATC AAG ATA CAA AAA ATA CAA AAG CCA GGG AAG TCA GAA CTT CGC 1203
Pro Gln Asn Ile Lys Ile Gln Lys Lys Pro Gly Lys Ser Glu Leu Arg

ATT AAC AAA GCA TCA CTG GCT GAT TCT GGA GAG TAT ATG TGC AAA GTG 1251
Ile Asn Lys Ala Ser Leu Ala Asp Ser Gly Glu Tyr Met Cys Lys Val
        Lys Ala Ser Leu Ala Asp Ser Gly Glu Tyr Met Xaa Lys
        (SEQ ID NO: 52) GGF-II 12

ATC AGC AAA TTA GGA AAT GAC AGT GCC TCT GCC AAT ATC ACC ATC GTG 1299
Ile Ser Lys Leu Gly Asn Asp Ser Ala Ser Ala Asn Ile Thr Ile Val

GAA TCA AAC GCT ACA TCT ACA ACC TCC ACA GGG ACA AGC CAT CTT GTA 1347
Glu Ser Asn Ala Thr Ser Thr Thr Ser Thr Gly Thr Ser His Leu Val
```

FIG. 44D

Nucleotide Sequence & Deduced Amino Acid Sequence of GGF2HBS5

```
AAA TGT GCG GAG AAG GAG AAA ACT TTC TGT GTG AAT GGA GGG GAG TGC                1395
Lys Cys Ala Glu Lys Glu Lys Thr Phe Cys Val Asn Gly Gly Glu Cys

TTC ATG GTG AAA GAC CTT TCA AAC CCC TCG AGA TAC TTG TGC AAG TGC                1443
Phe Met Val Lys Asp Leu Ser Asn Pro Ser Arg Tyr Leu Cys Lys Cys

CCA AAT GAG TTT ACT GGT GAT CGC TGC CAA AAC TAC GTA ATG GCC AGC                1491
Pro Asn Glu Phe Thr Gly Asp Arg Cys Gln Asn Tyr Val Met Ala Ser

TTC TAC AGT ACG TCC ACT CCC TTT CTG TCT CTG CCT GAA                            1530
Phe Tyr Ser Thr Ser Thr Pro Phe Leu Ser Leu Pro Glu

TAGGAGCATG CTCAGTTGGT GCTGCTTTCT TGTTGCTGCA TCTCCCCTCA GATTCCACCT              1590

AGAGCTAGAT GTGTCTTACC AGATCTAATA TTGACTGCCT CTGCCTGTCG CATGAGAACA              1650

TTAACAAAAG CAATTGTATT ACTTCCCTCTG TTCGCGACTA GTTGGCTCTG AGATACTAAT             1710

AGGTGTGTGA GGCTCCGGAT GTTTCTGGAA TTGATATTGA ATGATGTGAT ACAAATTGAT              1770

AGTCAATATC AAGCAGTGAA ATATGATAAT AAAGGCATTT CAAAGTCTCA CTTTTATTGA              1830

TAAAATAAAA ATCATTCTAC TGAACAGTCC ATCTTCTTTA TACAATGACC ACATCCTGAA              1890

AAGGGTGTTG CTAAGCTGTA ACCGATATGC ACTTGAAATG ATGGTAAGTT AATTTTGATT              1950

CAGAATGTGT TATTTGTCAC AAATAAACAT AATAAAAGGA AAAAAAAAAA AAA                     2003
```

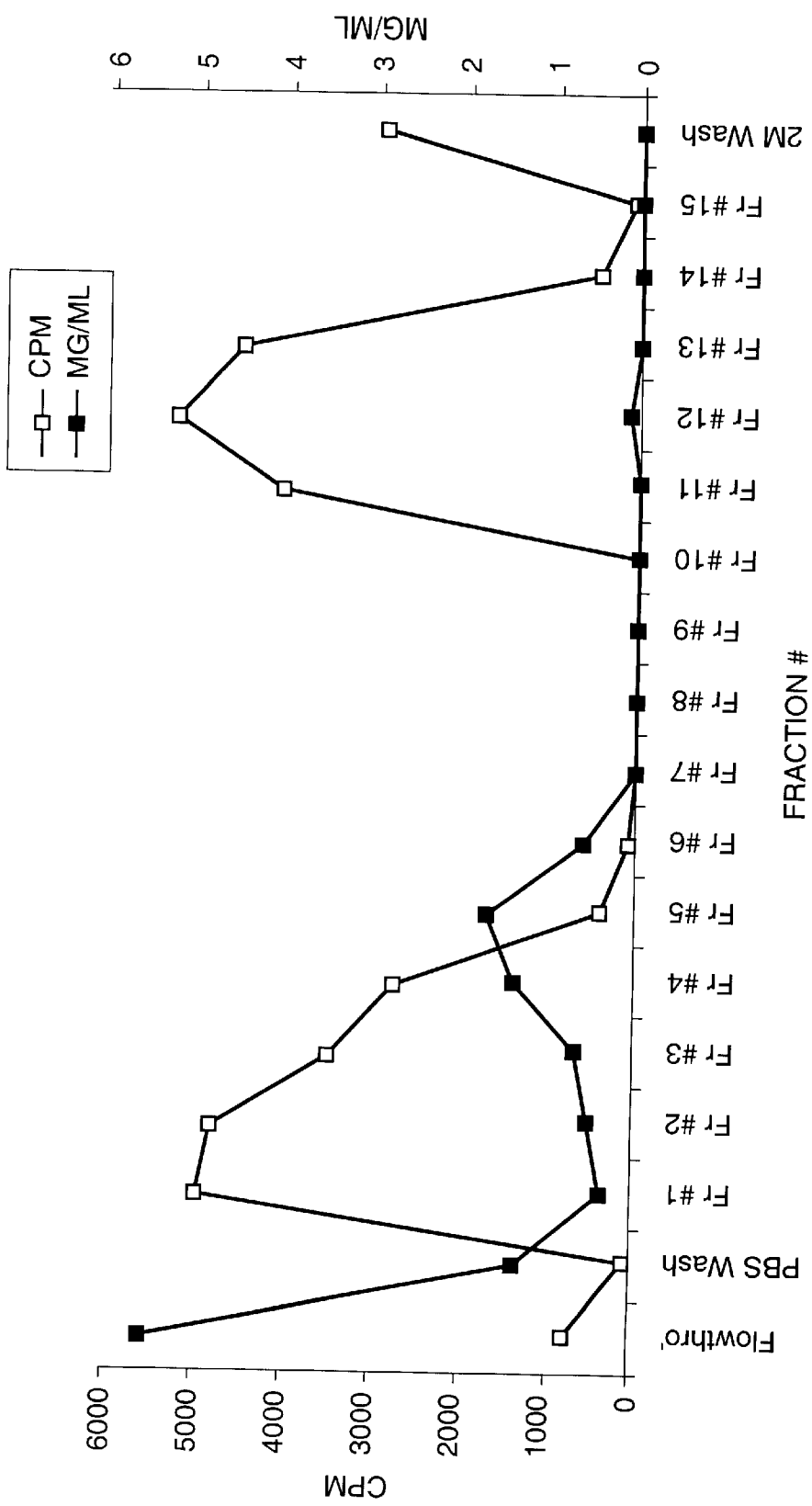

FIG. 46

Deduced Sequences of Human & Bovine Glial Growth Factors

SEQ ID NO: 170  GGFHBS5
SEQ ID NO: 171  GGFHFB1
SEQ ID NO: 172  GGFBPP5

```
                                                                        1
GGFHBS5    1   MRWRRAPRRSGRPGPRAQRPGSAARSSPPLPLLPLLLLLGTAALAPGAAAGNEAAPAGAS
                                    II-8         II-4
          61   VCYSSPPSVGSVQELAQRAAVVIEGKVHPQRRQQGALDRKAAAAAGEAGAWGGDREPPAA
                                                        III-1            II-10
         121   GPRALGPPAEEPLLAANGTVPSWPTAPVPSAGEPGEEAPYLVKVHQWVWAVKAGGLKKDSL
                  II-3                          II-2
         181   LTVRLGTWGHPAFPSCGRLKEDSRYIFFMEPDANSTSRAPAAFRASFPPLETGRNLKKEV
                                      O             2                3
                                                                 ALPPQLKEMKSQESAAGSK
GGFHBS5  241   SRVLCKRC..........OMSERKEGRGKGKKKERGSGKKPESAAGSQSP
GGFHFB1    1                                              R   K    G   D       VP   GP   R            R
GGFBPP5    1                                                                                           V
                          II-18                  III-14
                                                                 II-11        I-7, II-12,
                                                                              III-13
         268   IVLRCETSSEYSSLRFKNFKNGNELNRKNKPQNIKIQKKPGKSELRINKASLADSGEYMC
          53       *                                                                  *
          53
                      II-6                       K    S   S             R    S            ATSTS
                           III-12                                                5
         328   KVISKLGNDSASANITIVESN...............EIITGMPASTEGAYVSSESPIRISVSTEGANTSSS
         113     4                                                T             T
         113                                        6                III-15           8
         354   TTGTSHLVKCAEKEKTFCVNGGECFMVKDLSNPSRYLCKCPNEFTGDRCQNYVMASFYST
         173      *                         *                        * *
         173   A
                      9
         413   STPFLSLPE*
         232
         232
```

SEQ ID NO: 170  GGFHBS5

METHODS OF INCREASING MYOTUBE FORMATION OR SURVIVAL OR MUSCLE CELL MITOGENESIS, DIFFERENTIATION OR SURVIVAL USING A NEUREGULIN

This is a divisional of copending application Ser. No. 08/209,204, filed Mar. 8, 1994, which is a continuation-in-part of application Ser. No. 08/059,022, filed May 6, 1993 (abandoned). This is also a continuation-in-part of Ser. No. 08/036,555, filed Mar. 24, 1993, now U.S. Pat. No. 5,530,109, which is a continuation-in-part of Ser. No. 07/965,173, filed Oct. 23, 1992 (abandoned), Ser. No. 07/940,389, filed Sep. 3, 1992 (abandoned), Ser. No. 07/907,138, filed Jun. 30, 1992 (abandoned), and Ser. No. 07/863,703, filed Apr. 3, 1992, (abandoned).

BACKGROUND OF THE INVENTION

The invention relates to prophylactic or affirmative treatment of diseases and disorders of the musculature by administering polypeptides found in vertebrate species, which polypeptides are growth, differentiation and survival factors for muscle cells.

Muscle tissue in adult vertebrates will regenerate from reserve myoblasts called satellite cells. Satellite cells are distributed throughout muscle tissue and are mitotically quiescent in the absence of injury or disease. Following muscle injury or during recovery from disease, satellite cells will reenter the cell cycle, proliferate and 1) enter existing muscle fibers or 2) undergo differentiation into multinucleate myotubes which form new muscle fiber. The myoblasts ultimately yield replacement muscle fibers or fuse into existing muscle fibers, thereby increasing fiber girth by the synthesis of contractile apparatus components. This process is illustrated, for example, by the nearly complete regeneration which occurs in mammals following induced muscle fiber degeneration; the muscle progenitor cells proliferate and fuse together regenerating muscle fibers.

Several growth factors which regulate the proliferation and differentiation of adult (and embryonic) myoblasts in vitro have been identified. Fibroblast growth factor (FGF) is mitogenic for muscle cells and is an inhibitor of muscle differentiation. Transforming growth factor $\beta$ (TGF$\beta$) has no effect on myoblast proliferation, but is an inhibitor of muscle differentiation. Insulin-like growth factors (IGFs) have been shown to stimulate both myoblast proliferation and differentiation in rodents. Platelet derived growth factor (PDGF) is also mitogenic for myoblasts and is a potent inhibitor of muscle cell differentiation. (For a review of myoblast division and differentiation see: Florini and Magri, 1989:256:C701–C711).

In vertebrate species both muscle tissue and neurons are potential sources of factors which stimulate myoblast proliferation and differentiation. In diseases affecting the neuromuscular system which are neural in origin (i.e., neurogenic), the muscle tissue innervated by the affected nerve becomes paralyzed and wastes progressively. During peripheral nerve regeneration and recovery from neurologic and myopathic disease, neurons may provide a source of growth factors which elicit the muscle regeneration described above and provide a mechanism for muscle recovery from wasting and atrophy.

A recently described family of growth factors, the neuregulins, are synthesized by motor neurons (Marchioni et al. *Nature* 362:313, 1993) and inflammatory cells (Tarakhovsky et al., *Oncogene* 6:2187–2196 (1991)). The neuregulins and related p185$^{erbB2}$ binding factors have been purified, cloned and expressed (Benveniste et al., *PNAS* 82:3930–3934, 1985; Kimura et al., *Nature* 348:257–260, 1990; Davis and Stroobant, *J. Cell. Biol.* 110:1353–1360, 1990; Wen et al., *Cell* 69:559, 1992; Yarden and Ullrich, *Ann. Rev. Biochem.* 57:443, 1988; Holmes et al., *Science* 256:1205, 1992; Dobashi et al., *Proc. Natl. Acad. Sci.* 88:8582, 1991; Lupu et al., *Proc. Natl. Acad. Sci.* 89:2287, 1992). Recombinant neuregulins have been shown to be mitogenic for peripheral glia (Marchionni et al., Nature 362:313, 1993) and have been shown to influence the formation of the neuromuscular junction (Falls et al., Cell 72:801, 1993). Thus the regenerating neuron and the inflammatory cells associated with the recovery from neurogenic disease and nerve injury provide a source of factors which coordinate the remyelination of motor neurons and their ability to form the appropriate connection with their target. After muscle has been reinnervated the motor neuron may provide factors to muscle, stimulating muscle growth and survival.

Currently, there is no useful therapy for the promotion of muscle differentiation and survival. Such a therapy would be useful for treatment of a variety of neural and muscular diseases and disorders.

SUMMARY OF THE INVENTION

We have discovered that increased mitogenesis differentiation and survival of muscle cells may be achieved using proteins heretofore described as glial growth factors, acetylcholine receptor inducing activity (ARIA), heregulins, neu differentiation factor, and, more generally, neuregulins. We have discovered that these compounds are capable of inducing both the proliferation of muscle cells and the differentiation and survival of myotubes. These phenomena may occur in cardiac and smooth muscle tissues in addition to skeletal muscle tissues. Thus, the above compounds, regulatory compounds which induce synthesis of these compounds, and small molecules which mimic these compounds by binding to the receptors on muscle or by stimulating through other means the second messenger systems activated by the ligand-receptor complex are all extremely useful as prophylactic and affirmative therapies for muscle diseases.

A novel aspect of the invention involves the use of the above named proteins as growth factors to induce the mitogenesis, survival, growth and differentiation of muscle cells. Treating of the muscle cells to achieve these effects may be achieved by contacting muscle cells with a polypeptide described herein. The treatments may be provided to slow or halt net muscle loss or to increase the amount or quality of muscle present in the vertebrate.

These factors may be used to produce muscle cell mitogenesis, differentiation, and survival in a vertebrate (preferably a mammal, more preferably a human) by administering to the vertebrate an effective amount of a polypeptide or a related compound. Neuregulin effects on muscle may occur, for example, by causing an increase in muscle performance by inducing the synthesis of particular isoforms of the contractile apparatus such as the myosin heavy chain slow and fast isoforms; by promoting muscle fiber survival via the induction of synthesis of protective molecules such as, but not limited to, dystrophin; and/or by increasing muscle innervation by, for example, increasing acetylcholine receptor molecules at the neuromuscular junction.

The term muscle cell as used herein refers to any cell which contributes to muscle tissue. Myoblasts, satellite cells, myotubes, and myofibril tissues are all included in the term "muscle cells" and may all be treated using the methods of the invention. Muscle cell effects may be induced within skeletal, cardiac and smooth muscles.

Mitogenesis may be induced in muscle cells, including myoblasts or satellite cells, of skeletal muscle, smooth muscle or cardiac muscle. Mitogenesis as used herein refers to any cell division which results in the production of new muscle cells in the patient. More specifically, mitogenesis in vitro is defined as an increase in mitotic index relative to untreated cells of 50%, more preferably 100%, and most preferably 300%, when the cells are exposed to labelling agent for a time equivalent to two doubling times. The mitotic index is the fraction of cells in the culture which have labelled nuclei when grown in the presence of a tracer which only incorporates during S phase (i.e., BrdU) and the doubling time is defined as the average S time required for the number of cells in the culture to increase by a factor of two.

An effect on mitogenesis in vivo is defined as an increase in satellite cell activation as measured by the appearance of labelled satellite cells in the muscle tissue of a mammal exposed to a tracer which only incorporates during S phase (i.e., BrdU). The useful therapeutic is defined in vivo as a compound which increases satellite cell activation relative to a control mammal by at least 10%, more preferably by at least 50%, and most preferably by more than 200% when the mammal is exposed to labelling agent for a period of greater than 15 minutes and tissues are assayed between 10 hours and 24 hours after administration of the mitogen at the therapeutic dose. Alternatively, satellite cell activation in vivo may be detected by monitoring the appearance of the intermediate filament vimentin by immunological or RNA analysis methods. When vimentin is assayed, the useful mitogen is defined as one which causes expression of detectable levels of vimentin in the muscle tissue when the therapeutically useful dosage is provided.

Myogenesis as used herein refers to any fusion of myoblasts to yield myotubes. Most preferably, an effect on myogenesis is defined as an increase in the fusion of myoblasts and the enablement of the muscle differentiation program. The useful myogenic therapeutic is defined as a compound which confers any increase in the fusion index in vitro. More preferably, the compound confers at least a 2.0-fold increase and, most preferably, the compound confers a 3-fold or greater increase in the fusion index relative to the control. The fusion index is defined as the fraction of nuclei present in multinucleated cells in the culture relative to the total number of nuclei present in the culture. The percentages provided above are for cells assayed after 6 days of exposure to the myogenic compound and are relative to an untreated control. Myogenesis may also be determined by assaying the number of nuclei per area in myotubes or by measurement of the levels of muscle specific protein by Western analysis. Preferably, the compound confers at least a 2.0-fold increase in the density of myotubes using the assay provided, for example, herein, and, most preferably, the compound confers a 3-fold or greater increase.

The growth of muscle may occur by the increase in the fiber size and/or by increasing the number of fibers. The growth of muscle as used herein may be measured by A) an increase in wet weight, B) an increase in protein content, C) an increase in the number of muscle fibers, or D) an increase in muscle fiber diameter. An increase in growth of a muscle fiber can be defined as an increase in the diameter where the diameter is defined as the minor axis of ellipsis of the cross section. The useful therapeutic is one which increases the wet weight, protein content and/or diameter by 10% or more, more preferably by more than 50% and most preferably by more than 100% in an animal whose muscles have been previously degenerated by at least 10% and relative to a similarly treated control animal (i.e., an animal with degenerated muscle tissue which is not treated with the muscle growth compound). A compound which increases growth by increasing the number of muscle fibers is useful as a therapeutic when it increases the number of fibers in the diseased tissue by at least 1%, more preferably at least 20%, and most preferably, by at least 50%. These percentages are determined relative to the basal level in a comparable untreated undiseased mammal or in the contralateral undiseased muscle when the compound is administered and acts locally.

The survival of muscle fibers as used herein refers to the prevention of loss of muscle fibers as evidenced by necrosis or apoptosis or the prevention of other mechanisms of muscle fiber loss. Survival as used herein indicates an decrease in the rate of cell death of at least 10%, more preferably by at least 50%, and most preferably by at least 300% relative to an untreated control. The rate of survival may be measured by counting cells stainable with a dye specific for dead cells (such as propidium iodide) in culture when the cells are 8 days post-differentiation (i.e., 8 days after the media is changed from 20% to 0.5% serum).

Muscle regeneration as used herein refers to the process by which new muscle fibers form from muscle progenitor cells. The useful therapeutic for regeneration confers an increase in the number of new fibers by at least 1%, more preferably by at least 20%, and most preferably by at least 50%, as defined above.

The differentiation of muscle cells as used herein refers to the induction of a muscle developmental program which specifies the components of the muscle fiber such as the contractile apparatus (the myofibril). The therapeutic useful for differentiation increases the quantity of any component of the muscle fiber in the diseased tissue by at least 10% or more, more preferably by 50% or more, and most preferably by more than 100% relative to the equivalent tissue in a similarly treated control animal.

Atrophy of muscle as used herein refers to a significant loss in muscle fiber girth. By significant atrophy is meant a reduction of muscle fiber diameter in diseased, injured or unused muscle tissue of at least 10% relative to undiseased, uninjured, or normally utilized tissue.

Methods for treatment of diseases or disorders using the polypeptides or other compounds described herein are also part of the invention. Examples of muscular disorders which may be treated include skeletal muscle diseases and disorders such as myopathies, dystrophies, myoneural conductive diseases, traumatic muscle injury, and nerve injury. Cardiac muscle pathologies such as cardiomyopathies, ischemic damage, congenital disease, and traumatic injury may also be treated using the methods of the invention, as may smooth muscle diseases and disorders such as arterial sclerosis, vascular lesions, and congenital vascular diseases. For example, Duchenne's muscular dystrophy, Becker's dystrophy, and Myasthenia gravis are but three of the diseases which may be treated using the methods of the invention.

The invention also includes methods for the prophylaxis or treatment of a tumor of muscle cell origin such as rhabdomyosarcoma. These methods include administration of an effective amount of a substance which inhibits the binding of one or more of the polypeptides described herein and inhibiting the proliferation of the cells which contribute to the tumor.

The methods of the invention may also be used to treat a patient suffering from a disease caused by a lack of a neurotrophic factor. By lacking a neurotrophic factor is meant a decreased amount of neurotrophic factor relative to an unaffected individual sufficient to cause detectable decrease in neuromuscular connections and/or muscular strength. The neurotrophic factor may be present at levels 10% below those observed in unaffected individuals. More preferably, the factor is present at levels 20% lower than are observed in unaffected individuals, and most preferably the levels are lowered by 80% relative to unaffected individuals under similar circumstances.

The methods of the invention make use of the fact that the neuregulin proteins are encoded by the same gene. A variety of messenger RNA splicing variants (and their resultant proteins) are derived from this gene and many of these products show binding to p185$^{erbB2}$ and activation of the same. Products of this gene have been used to show muscle cell mitogenic activity (see Examples 1 and 2, below), differentiation (Examples 3 and 6), and survival (Examples 4 and 5). This invention provides a use for all of the known products of the neuregulin gene (described herein and in the references listed above) which have the stated activities as muscle cell mitogens, differentiation factors, and survival factors. Most preferably, recombinant human GGF2 (rhGGF2) is used in these methods.

The invention also relates to the use of other, not yet naturally isolated, splicing variants of the neuregulin gene. FIG. 29 shows the known patterns of splicing. These patterns are derived from polymerase chain reaction experiments (on reverse transcribed RNA), analysis of cDNA clones (as presented within), and analysis of published sequences encoding neuregulins (Peles et al., Cell 69:205 (1992) and Wen et al., Cell 69:559 (1992)). These patterns, as well as additional patterns disclosed herein, represent probable splicing variants which exist. The splicing variants are fully described in Goodearl et al., U.S. Ser. No. 08/036,555, filed Mar. 24, 1993, incorporated herein by reference.

More specifically, cell division, survival, differentiation and growth of muscle cells may be achieved by contacting muscle cells with a polypeptide defined by the formula

WYBAZCX wherein WYBAZCX is composed of the polypeptide segments shown in FIGS. 30A–30R (SEQ ID NOs:391–413); wherein W comprises the polypeptide segment F, or is absent wherein Y comprises the polypeptide segment E, or is absent; wherein Z comprises the polypeptide segment G or is absent; and wherein X comprises the polypeptide segment C/D HKL, C/D H, C/D HL, C/D D, C/D' HL, C/D' HKL, C/D' H, C/D' D, C/D C/D' HKL, C/D C/D' H, C/D C/D' HL, C/D C/D' D, C/D D' H, C/D D' HL, C/D D' HKL, C/D' D' H, C/D' D' HL, C/D' D' HKL, C/D C/D' D' H, C/D C/D' D' HL, or C/D C/D' D' HKL.

Furthermore, the invention includes a method of treating muscle cells by the application to the muscle cell of a 30 kD polypeptide factor isolated from the MDA-MB 231 human breast cell line; or 35 kD polypeptide factor isolated from the rat I-EJ transformed fibroblast cell line to the glial cell or 75 kD polypeptide factor isolated from the SKBR-3 human breast cell line; or 44 kD polypeptide factor isolated from the rat I-EJ transformed fibroblast cell line; or 25 kD polypeptide factor isolated from activated mouse peritoneal macrophages; or 45 kD polypeptide factor isolated from the MDA-MB 231 human breast cell; or 7 to 14 kD polypeptide factor isolated from the ATL-2 human T-cell line to the glial cell; or 25 kD polypeptide factor isolated from the bovine kidney cells; or 42 kD ARIA polypeptide factor isolated from brain;

46–47 kD polypeptide factor which stimulates 0–2A glial progenitor cells; or

43–45 kD polypeptide factor, GGFIII,175

U.S. patent application Ser. No. 07/931,041, filed Aug. 17, 1992, incorporated herein by reference.

The invention further includes methods for the use of the EGFL1, EGFL2, EGFL3, EGFL4, EGFL5, and EGFL6 polypeptides, FIGS. 37 to 42 and SEQ ID NOs:414–419, respectively, for the treatment of muscle cells in vivo and in vitro.

Also included in the invention is the administration of the GGF2 polypeptide whose sequence is shown in FIG. 44 for the treatment of muscle cells.

An additional important aspect of the invention are methods for treating muscle cells using:

(a) a basic polypeptide factor also known to have glial cell mitogenic activity, in the presence of fetal calf plasma, a molecular weight of from about 30 kD to about 36 kD, and including within its amino acid sequence any one or more of the following peptide sequences:

F K G D A H T E (SEQ ID NO: 1)
A S L A D E Y E Y M X K (SEQ ID NO:22)
T E T S S S G L X L K (SEQ ID NO:23)
A S L A D E Y E Y M R K (SEQ ID NO:24)
A G Y F A E X A R (SEQ ID NO:25)
T T E M A S E Q G A (SEQ ID NO:26)
A K E A L A A L K (SEQ ID NO:27)
F V L Q A K K (SEQ ID NO:28)
E T Q P D P G Q I L K K V P M V I G A Y T (SEQ ID NO:29)
E Y K C L K F K W F K K A T V M (SEQ ID NO: 17)
E X K F Y V P (SEQ ID NO: 19)
K L E F L X A K (SEQ ID NO: 32); and (b) a basic polypeptide factor for use in treating muscle cells which is also known to stimulate glial cell mitogenesis in the presence of fetal calf plasma, has a molecular weight of from about 55 kD to about 63 kD, and including within its amino acid sequence any one or more of the following peptide sequences:

V H Q V W A A K (SEQ ID NO:45)
Y I F F M E P E A X S S G (SEQ ID NO:46)
L G A W G P P A F P V X Y (SEQ ID NO:47)
W F V V I E G K (SEQ ID NO:48)
A S P V S V G S V Q E L Q R (SEQ ID NO:49)
V C L L T V A A L P P T (SEQ ID NO:50)
K V H Q V W A A K (SEQ ID NO:51)
K A S L A D S G E Y M X K (SEQ ID NO:52)
D L L L X V (SEQ ID NO: 53)

Methods for the use of the peptide sequences set out above, derived from the smaller molecular weight polypeptide factor, and from the larger molecular weight polypeptide factor, are also aspects of this invention. Monoclonal antibodies to the above peptides are themselves useful investigative tools and therapeutics.

Thus, the invention further embraces methods of using a polypeptide factor having activities useful for treating muscle cells and including an amino acid sequence encoded by:

(a) a DNA sequence shown in any one of FIGS. 27A–E, SEQ ID NOs. (SEQ ID NOs:133–135), respectively;

(b) a DNA sequence shown in FIG. 21, SEQ ID NO:89;

(c) the DNA sequence represented by nucleotides 281–557 of the sequence shown in FIG. 27A, SEQ ID NO:133; or (d) a DNA sequence hybridizable to any one of the DNA sequences according to (a), (b) or (c).

Following factors as muscle cell mitogens:

(a) a basic polypeptide factor which has, if obtained from bovine pituitary material, an observed molecular weight, whether in reducing conditions or not, of from about 30 kD to about 36 kD on SDS-polyacrylamide gel electrophoresis which factor has muscle cell mitogenic activity including stimulating the division of myoblasts, and when isolated using reversed-phase HPLC retains at least 50% of said activity after 10 weeks incubation in 0.1% trifluoroacetic acid at 4° C.; and (b) a basic polypeptide factor which has, if obtained from bovine pituitary material, an observed molecular weight, under non-reducing conditions, of from about 55 kD to about 63 Kd on SDS-polyacrylamide gel electrophoresis which factor the human equivalent of which is encoded by DNA clone GGF2HBS5 and which factor has muscle cell mitogenic activity and when isolated using reversed-phase HPLC retains at least 50% of the activity after 4 days incubation in 0.1% trifluoroacetic acid at 4° C.

Thus other important aspects of the invention are the use of:

(a) A series of human and bovine polypeptide factors having cell mitogenic activity including stimulating the division of muscle cells. These peptide sequences are shown in FIGS. 30A–R, 31A–B, 32A–B, and 33A–C, SEQ ID NOs: 386, 388, 389, and 391–413, respectively.

(b) A series of polypeptide factors having cell mitogenic activity including stimulating the division of muscle cells and purified and characterized according to the procedures outlined by Lupu et al. Science 249: 1552 (1990); Lupu et al. Proc. Natl. Acad. Sci USA 88: 2287 (1992); Holmes et al. Science 256: 1205 (1992); Peles et al. 69: 205 (1992); Yarden and Peles Biochemistry 30: 3543 (1991); Dobashi et al. Proc. Natl. Acad. Sci. 88: 8582 (1991); Davis et al. Biochem. Biophys. Res. Commun. 179: 1536 (1991); Beaumont et al., patent application PCT/US91/03443 (1990); Bottenstein, U.S. Pat. No. 5,276,145, issued Jan. 4, 1994; and Greene et al. patent application PCT/US91/02331 (1990).

(c) A polypeptide factor (GGFBPP5) having glial cell mitogenic activity including stimulating the division of muscle cells. The amino acid sequence is shown in FIGS. 31A–B (SEQ ID NO: 389).

Methods for stimulating mitogenesis of a myoblast by contacting the myoblast cell with a polypeptide defined above as a muscle cell mitogen in vivo or in vitro are included as features of the invention.

Muscle cell treatments may also be achieved by administering DNA encoding the polypeptide compounds described above in an expressible genetic construction. DNA encoding the polypeptide may be administered to the patient using techniques known in the art for delivering DNA to the cells. For example, retroviral vectors, electroporation or liposomes may be used to deliver DNA.

The invention includes the use of the above named family of proteins as extracted from natural sources (tissues or cell lines) or as prepared by recombinant means.

Other compounds in particular, peptides, which bind specifically to the p185$^{erbB2}$ receptor can also be used according to the invention as muscle cell mitogens. A candidate compound can be routinely screened for p185$^{erbB2}$ binding, and, if it binds, can then be screened for glial cell mitogenic activity using the methods described herein.

The invention includes use of any modifications or equivalents of the above polypeptide factors which do not exhibit a significantly reduced activity. For example, modifications in which amino acid content or sequence is altered without substantially adversely affecting activity are included. The statements of effect and use contained herein are therefore to be construed accordingly, with such uses and effects employing modified or equivalent factors being part of the invention.

The human peptide sequences described above and presented in FIGS. 30A–R, 31A–B, 32A–B, and 33A–C (SEQ ID NOs: 386, 388, 389, and 391–413), respectively, represent a series of splicing variants which can be isolated as full length complementary DNAs (cDNAS) from natural sources (cDNA libraries prepared from the appropriate tissues) or can be assembled as DNA constructs with individual exons (e.g., derived as separate exons) by someone skilled in the art.

The invention also includes a method of making a medicament for treating muscle cells, i.e., for inducing muscular mitogenesis, myogenesis, differentiation, or survival, by administering an effective amount of a polypeptide as defined above. Such a medicament is made by administering the polypeptide with a pharmaceutically effective carrier.

Another aspect of the invention is the use of a pharmaceutical or veterinary formulation comprising any factor as defined above formulated for pharmaceutical or veterinary use, respectively, optionally together with an acceptable diluent, carrier or excipient and/or in unit dosage form. In using the factors of the invention, conventional pharmaceutical or veterinary practice may be employed to provide suitable formulations or compositions.

Thus, the formulations to be used as a part of the invention can be applied to parenteral administration, for example, intravenous, subcutaneous, intramuscular, intraorbital, ophthalmic, intraventricular, intracranial, intracapsular, intraspinal, intracisternal, intraperitoneal, topical, intranasal, aerosol, scarification, and also oral, buccal, rectal or vaginal administration.

The formulations of this invention may also be administered by the transplantation into the patient of host cells expressing the DNA encoding polypeptides which are effective for the methods of the invention or by the use of surgical implants which release the formulations of the invention.

Parenteral formulations may be in the form of liquid solutions or suspensions; for oral administration, formulations may be in the form of tablets or capsules; and for intranasal formulations, in the form of powders, nasal drops, or aerosols.

Methods well known in the art for making formulations are to be found in, for example, "Remington's Pharmaceutical Sciences." Formulations for parenteral administration may, for example, contain as excipients sterile water or saline, polyalkylene glycols such as polyethylene glycol, oils of vegetable origin, or hydrogenated naphthalenes, biocompatible, biodegradable lactide polymer, or polyoxyethylene-polyoxypropylene copolymers may be used to control the release of the present factors. Other potentially useful parenteral delivery systems for the factors include ethylene-vinyl acetate copolymer particles, osmotic pumps, implantable infusion systems, and liposomes. Formulations for inhalation may contain as excipients, for example, lactose, or may be aqueous solutions containing, for example, polyoxyethylene-9-lauryl ether, glycocholate and deoxycholate, or may be oily solutions for administration in the form of nasal drops, or as a gel to be applied intranasally. Formulations for parenteral administration may also include glycocholate for buccal administration, methoxysalicylate for rectal administration, or citric acid for vaginal administration.

The present factors can be used as the sole active agents, or can be used in combination with other active ingredients, e.g., other growth factors which could facilitate neuronal survival in neurological diseases, or peptidase or protease inhibitors.

The concentration of the present factors in the formulations of the invention will vary depending upon a number of issues, including the dosage to be administered, and the route of administration.

In general terms, the factors of this invention may be provided in an aqueous physiological buffer solution containing about 0.1 to 10% w/v compound for parenteral administration. General dose ranges are from about 1 mg/kg to about 1 g/kg of body weight per day; a preferred dose range is from about 0.01 mg/kg to 100 mg/kg of body weight per day. The preferred dosage to be administered is likely to depend upon the type and extent of progression of the pathophysiological condition being addressed, the overall health of the patient, the make up of the formulation, and the route of administration.

The polypeptide factors utilized in the methods of the invention can also be used as immunogens for making antibodies, such as monoclonal antibodies, following standard techniques. These antibodies can, in turn, be used for therapeutic or diagnostic purposes. Thus, conditions perhaps associated with muscle diseases resulting from abnormal levels of the factor may be tracked by using such antibodies. In vitro techniques can be used, employing assays on isolated samples using standard methods. Imaging methods in which the antibodies are, for example, tagged with radioactive isotopes which can be imaged outside the body using techniques for the art of tumor imaging may also be employed.

A further general aspect of the invention is the use of a factor of the invention in the manufacture of a medicament, preferably for the treatment of a muscular disease or disorder. The "GGF2" designation is used for all clones which were previously isolated with peptide sequence data derived from GGF-II protein (i.e., GGF2HBS5, GGF2BPP3) and, when present alone (i.e., GGF2 or rhGGF2), to indicate recombinant human protein encoded by plasmids isolated with peptide sequence data derived from the GGF-II protein (i.e., as produced in insect cells from the plasmid HBS5). Recombinant human GGF from the GGFHBS5 clone is called GGF2, rhGGF2 and GGF2HBS5 polypeptide.

Treating as used herein means any administration of the compounds described herein for the purpose of increasing muscle cell mitogenesis, survival, and/or differentiation, and/or decreasing muscle atrophy and degeneration. Most preferably, the treating is for the purpose of reducing or diminishing the symptoms or progression of a disease or disorder of the muscle cells. Treating as used herein also means the administration of the compounds for increasing or altering the muscle cells in healthy individuals. The treating may be brought about by the contacing of the muscle cells which are sensitive or responsive to the compounds described herein with an effective amount of the compound, as described above. Inhibitors of the compounds described herein may also be used to halt or slow diseases of muscle cell proliferation.

BRIEF DESCRIPTION OF THE DRAWINGS

The drawings will first be described.
Drawings

FIGS. 8, 9, 10 and 11 are the peptide sequences derived from GGF-I and GGF-II, SEQ ID NOs:1–20, 22–29, 32–39, 45–53, and 164–166, respectively, (see Examples 11–13 hereinafter).

FIG. 8 shows the 21 peptide sequences (SEQ ID NOs: 1–20, and 29) obtained from lysyl endopeptidase and protease V8 digestion of purified bovine pituitary GGF1.

FIG. 9, Panel A, is the sequences of GGF-I peptides used to design degenerate oligonucleotide probes and degenerate PCR primers are listed (SEQ ID Nos. 1, 17 and 22–29). Some of the sequences in Panel A were also used to design synthetic peptides. Panel B is a listing of the sequences of novel peptides that were too short (less than 9 amino acids) for the design of degenerate probes or degenerate PCR primers (SEQ ID Nos. 19 and 32);

FIG. 10 shows various trypsin and lysyl endopeptidase C peptide sequences derived from GGF2, SEQ ID NOs: 33–39, 51–52, and 164–166.

FIG. 11, Panel A, is a listing of the sequences of GGF-II peptides used to design degenerate oligonucleotide probes and degenerate PCR primers (SEQ ID Nos. 45–52). Some of the sequences in Panel A were used to design synthetic peptides. Panel B is a listing of the novel peptide that was too short (less than 6 amino acids) for the design of degenerate probes or degenerate PCR primers (SEQ ID No. 53);

FIGS. 12, 13A, 13B, 14, 15, 16, 17, 18, and 19 relate to Example 8, below, and depict the mitogenic activity of factors of the invention;

FIG. 12 shows a graph comparing BrUdR-ELISA and [$^{125}$I]UdR counting methods for the DNA synthesis assay in Schwann cell cultures.

FIGS. 13A–B show graphs comparing Br-UdR immunoreactivity with the number of Br-UdR labeled cells.

FIG. 14 shows the mitogenic response of rat sciatic nerve Schwann cells to GGFs.

FIG. 15 shows a graph quantifying DNA synthesis in rat sciatic nerve Schwann cells and 3T3 fibroblasts in the presence of GGFs.

FIG. 16 shows a graph of the mitogenic response of BHK 21 C13 cells to FCS and GGFs.

FIG. 17 shows a graph of survival and proliferation of BH 21 C13 cell micro cultures after 48 hours in the presence of GGFs.

FIG. 18 shows a graph of the mitogenic response of C6 cells to FCS.

FIGS. 19A–B are graphs showing the mitogenic response of C6 cells to aFGF and GGFs.

FIGS. 20, 21, 22, 23, 24, 25, 26, and 27 relate to Example 10, below and are briefly described below:

FIG. 20 is a listing of the degenerate oligonucleotide probes (SEQ ID NOs: 54–76 and 78–88) designed from the novel peptide sequences in FIG. 9, Panel A and FIG. 11, Panel A;

FIG. 21 depicts a stretch of the putative bovine GGF-II gene sequence from the recombinant bovine genomic phage GGF2BG1, containing the binding site of degenerate oligonucleotide probes 609 and 650 (see FIG. 20, SEQ ID NOs: 69 and 72, respectively). The figure is the coding strand of the DNA sequence (SEQ. ID NO: 89) and the deduced amino acid sequence (SEQ. ID NO: 390) in the third reading frame. The sequence of peptide 12 from factor 2 (bold) is part of a 66 amino acid open reading frame (nucleotides 75272);

FIG. 22A shows the degenerate PCR primers (SEQ ID NOs: 90–108) and

FIG. 22B shows the unique PCR primers (SEQ ID NOs: 109–119) used in experiments to isolate segments of the bovine GGF-II coding sequences present in RNA from posterior pituitary;

FIG. 23 depicts of the nine distinct contiguous bovine GGF-II cDNA structures and sequences that were obtained in PCR amplification experiments. The top line of the Figure is a schematic of the coding sequences which contribute to the cDNA structures that were characterized;

FIG. 24 is a physical map of bovine recombinant phage of GGF2BG1. The bovine fragment is roughly 20 kb in length and contains two exons (bold) of the bovine GGF-II gene. Restriction sites for the enzymes Xbal, SpeI, Ndel, EcoRI, Kpnl, and SstI have been placed on this physical map. Shaded portions correspond to fragments which were subcloned for sequencing;

FIG. 25 is a schematic of the structure of three alternative gene products of the putative bovine GGF-II gene. Exons are listed A through E in the order of their discovery. The alternative splicing patterns 1, 2 and 3 generate three overlapping deduced protein structures (GGF2BPP1, 2, and 3), which are displayed in the various FIGS. 27A–E (described below);

FIG. 26 (SEQ ID NOs: 42, 45, 52, 53, 120–128, and 130–132) is a comparison of the GGF-I and GGF-II sequences identified in the deduced protein sequences shown in FIGS. 27A–E (described below) with the novel peptide sequences listed in FIGS. 9 and 11. The Figure shows that six of the nine novel GGF-II peptide sequences are accounted for in these deduced protein sequences. Two peptide sequences similar to GGF-I sequences are also found;

FIG. 27A is a listing of the coding strand DNA sequence (SEQ ID NO: 133) and deduced amino acid sequence (SEQ ID NO: 383) of the cDNA obtained from splicing pattern number 1 in FIG. 25. This partial cDNA of the putative bovine GGF-II gene encodes a protein of 206 amino acids in length. Peptides in bold were those identified from the lists presented in FIGS. 9 and 11. Potential glycosylation sites are underlined (along with polyadenylation signal AATAAA (SEQ ID NO: 420));

FIGS. 27B–C is a listing of the coding strand DNA sequence (SEQ ID NO: 134) and deduced amino acid sequence (SEQ ID NO: 385) of the cDNA obtained from splicing pattern number 2 in FIG. 25. This partial cDNA of the putative bovine GGF-II gene encodes a protein of 263 amino acids in length. Peptides in bold are those identified from the lists presented in FIGS. 7 and 9. Potential glycosylation sites are underlined (along with polyadenylation signal AATAAA (SEQ ID NO: 420));

FIGS. 27D–E is a listing of the coding strand DNA sequence (SEQ ID NO: 135) and deduced amino acid sequence (SEQ ID NO: 387) of the cDNA obtained from splicing pattern number 3 in FIG. 25. This partial cDNA of the putative bovine GGF-II gene encodes a protein of 257 amino acids in length. Peptides in bold are those identified from the lists in FIGS. 9 and 11. Potential glycosylation sites are underlined (along with polyadenylation signal AATAAA (SEQ ID NO: 420)).

FIG. 29 is a diagram of representative splicing variants. The coding segments are represented by F, E, B, A, G, C, C/D, C/D', D, D', H, K and L. The location of the peptide sequences derived from purified protein are indicated by "o".

FIGS. 30A–R is a listing of the DNA sequences (SEQ ID NOs: 44, 77, 136–147, 160, 161, 163, and 173–178) and predicted peptide sequences (SEQ ID NOs: 391–413) of the coding segments of GGF. Line 1 is a listing of the predicted amino acid sequences of bovine GGF, line 2 is a listing of the nucleotide sequences of bovine GGF, line 3 is a listing of the nucleotide sequences of human GGF (heregulin) (nucleotide base matches are indicated with a vertical line) and line 4 is a listing of the predicted amino acid sequences of human GGF/heregulin where it differs from the predicted bovine sequence. Coding segments E, A' and K represent only the bovine sequences. Coding segment D' represents only the human (heregulin) sequence.

FIGS. 31A–B is the predicted GGF2 amino acid sequence and nucleotide sequence of BPP5 (SEQ ID NO: 389 and SEQ ID NO: 148, respectively). The upper line is the nucleotide sequence and the lower line is the predicted amino acid sequence.

FIGS. 32A–B is the predicted amino acid sequence and nucleotide sequence of GGF2BPP2 (SEQ ID NO: 149 and SEQ ID NO: 386, respectively). The upper line is the nucleotide sequence and the lower line is the predicted amino acid sequence.

FIGS. 33A–C is the predicted amino acid sequence and nucleotide sequence of GGF2BPP4 (SEQ ID NO: 388 and SEQ ID NO: 150, respectively). The upper line is the nucleotide sequence and the lower line is the predicted amino acid sequence.

FIG. 34 (SEQ ID NOs:151–153) depicts the alignment of two GGF peptide sequences (GGF2BPP4 and GGF2BPP5) with the human EGF (hEGF). Asterisks indicate positions of conserved cysteines.

Figure 36A:
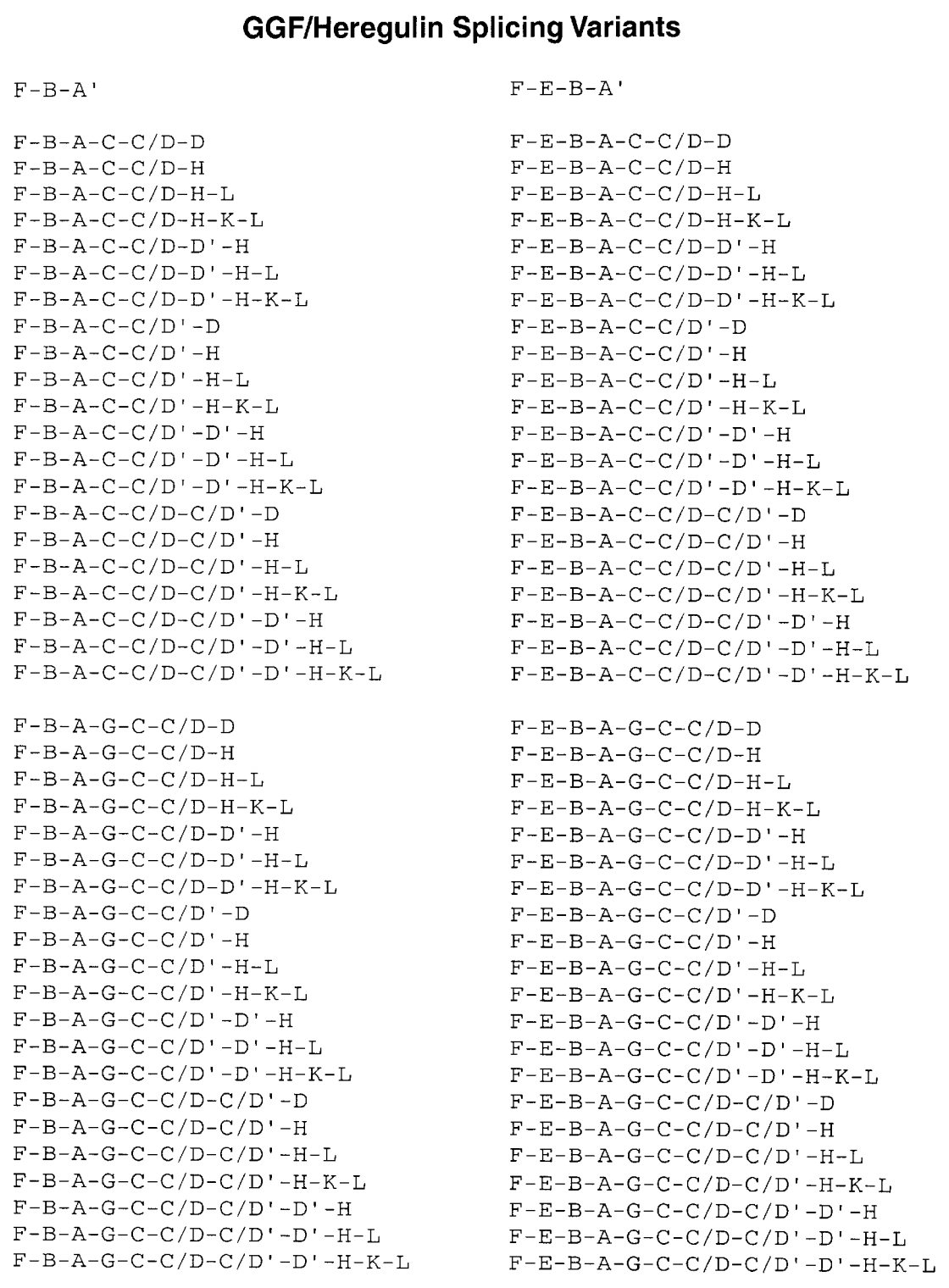
Figure 36B:
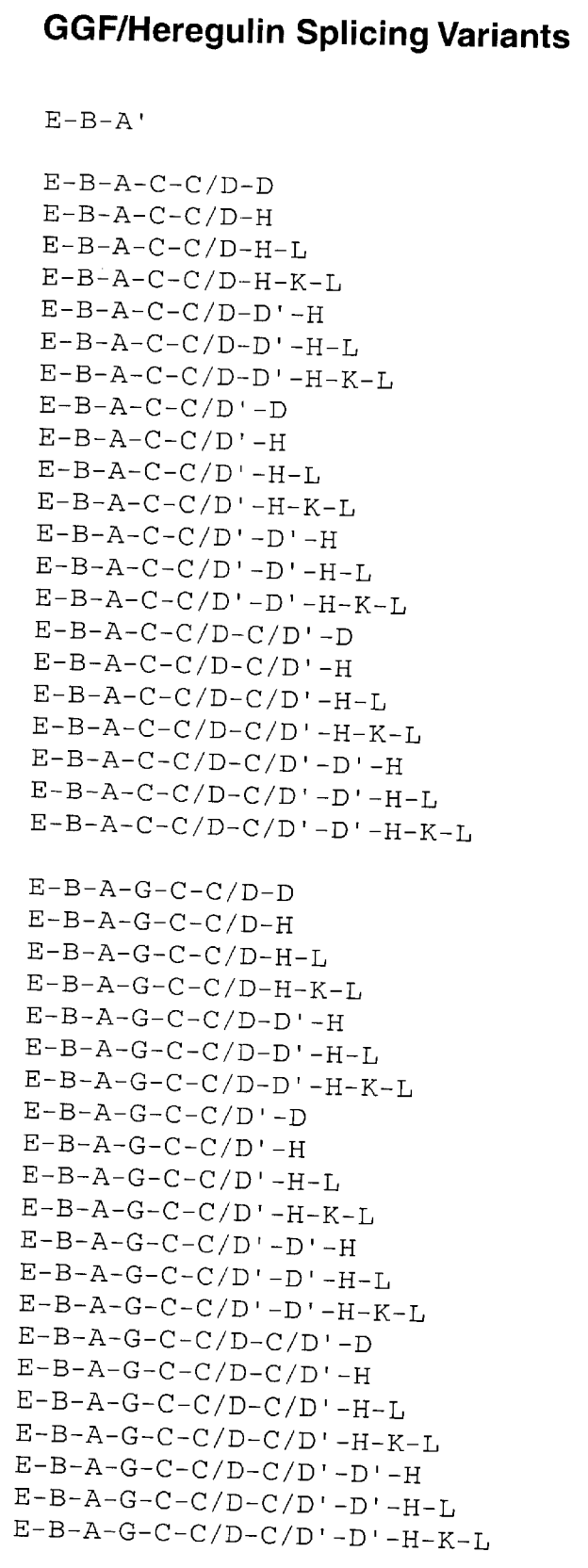

FIGS. 36A–B is a list of splicing variants derived from the sequences shown in FIGS. 30A–R.

FIG. 37 is the predicted amino acid sequence, bottom (SEQ ID NO:414), and nucleic sequence, top, of EGFL1 (SEQ ID NO:154).

FIG. 38 is the predicted amino acid sequence, bottom (SEQ ID NO:415), and nucleic sequence, top, of EGFL2 (SEQ ID NO:155).

FIG. 39 is the predicted amino acid sequence, bottom (SEQ ID NO: 416), and nucleic sequence, top, of EGFL3 (SEQ ID NO:156).

FIG. 40 is the predicted amino acid sequence, bottom (SEQ ID NO: 417), and nucleic sequence, top, of EGFL4 (SEQ ID NO:157).

FIG. 41 is the predicted amino acid sequence, bottom (SEQ ID NO: 418), and nucleic sequence, top, of EGFL5 (SEQ ID NO:158).

FIG. 42 is the predicted amino acid sequence, bottom (SEQ ID NO: 419), and nucleic sequence, top, of EGFL6 (SEQ ID NO:159).

FIGS. 44A–D is the predicted amino acid sequence (middle) SEQ ID NO: 170) and nucleic sequence (top) of GGF2HBS5 (SEQ ID No. 21). The bottom (intermittent) sequence represents peptide sequences derived from GGF-II preparations (see FIGS. 8, 9).

FIG. 45(A) is a graph showing the purification of rGGF on cation exchange column by fraction.

FIG. 46 is the sequence of the GGFHBS5, GGFHFB1 and GGFBPP5 polypeptides (SEQ ID NOs:170, 171, and 172, respectively).

DETAILED DESCRIPTION

Figure 1:
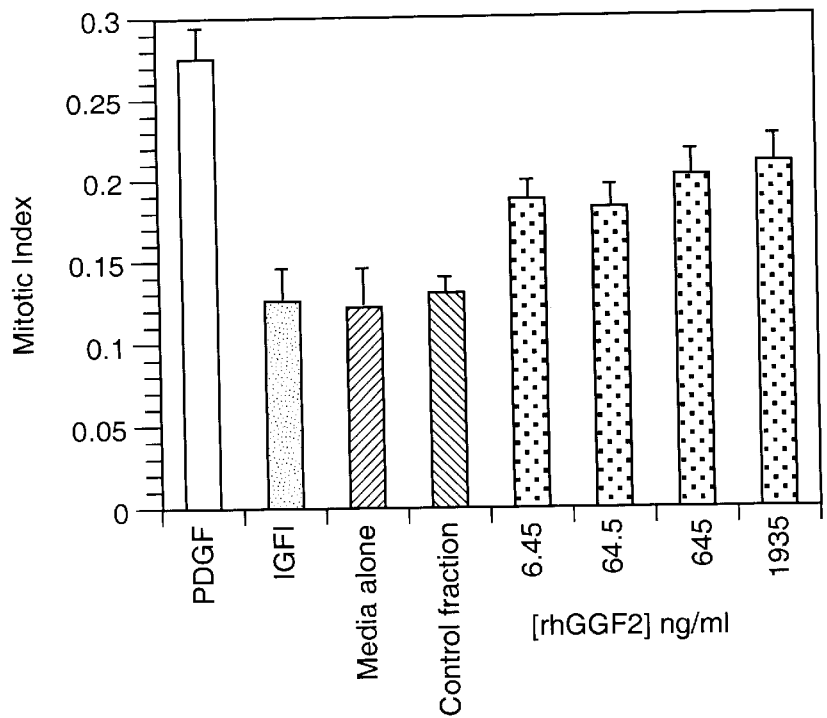
FIG. 1 is a graph showing the results of rhGGF2 in a myoblast mitogenesis assay.

The invention pertains to the use of isolated and purified neuregulin factors and DNA sequences encoding these factors, regulatory compounds which increase the extramuscular concentrations of these factors, and compounds which are mimetics of these factors for the induction of muscle cell mitogenesis, differentiation, and survival of the muscle cells in vivo and in vitro.

It is evident that the gene encoding GGF/p185$^{erbB2}$ binding neuregulin proteins produces a number of variably-sized, differentially-spliced RNA transcripts that give rise to a series of proteins. These proteins are of different lengths and contain some common peptide sequences and some unique peptide sequences. The conclusion that these factors are encoded by a single gene is supported by the differentially-spliced RNA sequences which are recoverable from bovine posterior pituitary and human breast cancer cells (MDA-MB-231)). Further support for this conclusion derives from the size range of proteins which act as both mitogens for muscle tissue (as disclosed herein) and as ligands for the p185$^{erbB2}$ receptor (see below).

Further evidence to support the fact that the genes encoding GGF/p185$^{erbB2}$ binding proteins are homologous comes from nucleotide sequence comparison. Holmes et al., (Science 256:1205–1210, 1992) demonstrate the purification of a 45-kilodalton human protein (Heregulin-α) which specifically interacts with the receptor protein p185$^{erbB2}$. Peles et al. (Cell 69:205 (1992)) and Wen et al. (Cell 69:559 (1992)) describe a complementary DNA isolated from rat cells encoding a protein called "neu differentiation factor" (NDF). The translation product of the NDF cDNA has p185$^{erbB2}$ binding activity. Several other groups have reported the purification of proteins of various molecular weights with p185$^{erbB2}$ binding activity. These groups include Lupu et al. ((1992) Proc. Natl. Acad. Sci. USA 89:2287); Yarden and Peles ((1991) Biochemistry 30:3543); Lupu et al. ((1990) Science 249:1552)); Dobashi et al. ((1991) Biochem. Biophys. Res. Comm. 179:1536); and Huang et al. ((1992) J. Biol. Chem. 257:11508–11512).

We have found that p185$^{erbB2}$ receptor binding proteins stimulate muscle cell mitogenesis and hence, stimulates myotube formation (myogenesis). This stimulation results in increased formation of myoblasts and increased formation of myotubes (myogenesis). The compounds described herein also stimulate increased muscle growth, differentiation, and survival of muscle cells. These ligands include, but are not limited to the GGF's, the neuregulins, the heregulins, NDF, and ARIA. As a result of this mitogenic activity, these proteins, DNA encoding these proteins, and related compounds may be administered to patients suffering from traumatic damage or diseases of the muscle tissue. It is understood that all methods provided for the purpose of mitogenesis are useful for the purpose of myogenesis. Inhibitors of these ligands (such as antibodies or peptide fragments) may be administered for the treatment of muscle derived tumors.

These compounds may be obtained using the protocols described herein (Examples 9–17) and in Holmes et al., Science 256: 1205 (1992); Peles et al., Cell 69:205 (1992); Wen et al., Cell 69:559 (1992); Lupu et al., Proc. Natl. Acad. Sci. USA 89:2287 (1992); Yarden and Peles, Biochemistry 30:3543 (1991); Lupu et al., Science 249:1552 (1990); Dobashi et al., Biochem. Biophys. Res. Comm. 179:1536 (1991); Huang et al., J. Biol. Chem. 257:11508–11512 (1992); Marchionni et al., Nature 362:313, (1993); and in the GGF-III application (U.S. Ser. No. 07/931,041), all of which are incorporated herein by reference. The sequences are provided and the characteristics described for many of these compounds. For sequences see FIGS. 8–11, 20–27C, 29–34, 36–44, and 46. For protein characteristics see FIGS. 12–19, 28 35, 45A and 45B.

Compounds may be assayed for their usefulness in vitro using the methods provided in the examples below. In vivo testing may be performed as described in Example 1 and in Sklar et al., In Vitro Cellular and Developmental Biology 27A:433–434, 1991.

OTHER EMBODIMENTS

The invention includes methods for the use of any protein which is substantially homologous to the coding segments in FIGS. 30A–R (SEQ ID NOs:391–413) as well as other naturally occurring GGF polypeptides for the purpose of inducing muscle mitogenesis. Also included are the use of: allelic variations; natural mutants; induced mutants; proteins encoded by DNA that hybridizes under high or low stringency conditions to a nucleic acid naturally occurring (for definitions of high and low stringency see Current Protocols in Molecular Biology, John Wiley & Sons, New York, 1989, 6.3.1–6.3.6, hereby incorporated by reference); and the use of polypeptides or proteins specifically bound by antisera to GGF polypeptides. The term also includes the use of chimeric polypeptides that include the GGF polypeptides comprising sequences from FIG. 28 for the induction of muscle mitogenesis.

As will be seen from Example 8, below, the present factors exhibit mitogenic activity on a range of cell types. The general statements of invention above in relation to formulations and/or medicaments and their manufacture should clearly be construed to include appropriate products and uses.

A series of experiments follow which provide additional basis for the claims described herein. The following examples relating to the present invention should not be construed as specifically limiting the invention, or such variations of the invention, now known or later developed.

The examples illustrate our discovery that recombinant human GGF2 (rhGGF2) confers several effects on primary human muscle culture. rhGGF2 has significant effects in three independent biological activity assays on muscle cultures. The polypeptide increased mitogenesis as measured by proliferation of subconfluent quiescent myoblasts, increased differentiation by confluent myoblasts in the presence of growth factor, and increased survival of differentiated myotubes as measured by loss of dye exclusion and increased acetylcholine receptor synthesis. These activities indicate efficacy of GGF2 and other neuregulins in inducing muscle repair, regeneration, and prophylactic effects on muscle degeneration.

EXAMPLE 1

Mitogenic Activity of rhGGF on Myoblasts

Clone GGF2HBS5 was expressed in recombinant Baculovirus infected insect cells as described in Example 13, infra, and the resultant recombinant human GGF2 was added to myoblasts in culture (conditioned medium added at 40 µl/ml). Myoblasts (057A cells) were grown to preconfluence in a 24 well dish. Medium was removed and replaced with DMEM containing 0.5% fetal calf serum with or without GGF2 conditioned medium at a concentration of 40 µl/ml. Medium was changed after 2 days and cells were fixed and stained after 5 days. Total nuclei were counted as were the number of nuclei in myoblasts (Table 1).

TABLE 1

| Treatment | Total Number of Nuclei/mm$^2$ | Nuclei in Myotubes | Fusion Index |
|---|---|---|---|
| Control | 395 ± 28.3 | 204 ± 9.19 | 0.515 ± 0.01 |
| GGF 40 µl/ml | 636 ± 8.5 | 381 ± 82.7 | 0.591 ± 0.15 |

GGF treated myoblasts showed an increased number of total nuclei (636 nuclei) over untreated controls (395 nuclei) indicating mitogenic activity. rhGGF2 treated myotubes had a greater number of nuclei (381 nuclei) than untreated controls (204 nuclei). Thus, rhGGF2 enhances the total number of nuclei through proliferation and increased cell survival. rhGGF2 is also likely to enhance the formation of myotubes.

The mitogenic activity of rhGGF2 may be measured in vivo by giving a continuous supply of GGF2 and [$^3$H] thymidine to rat muscle via an osmotic mini pump. The muscle bulk is determined by wet weight after one and two weeks of treatment. DNA replication is measured by counting labeled nuclei in sections after coating for autoradiography (Sklar et al., In Vitro Cellular and Developmental Biology 27A:433–434, 1991) in sham and rhGGF2-treated muscle. Denervated muscle is also examined in this rat animal model via these methods and this method allows the assessment of the role of rhGGF2 in muscle atrophy and repair. Mean fiber diameter can also be used for assessing effects of FGF on prevention of atrophy.

EXAMPLE 2

Effect of rhGGF2 on Muscle Cell Mitogenesis

Quiescent primary clonal human myoblasts were prepared as previously described (Sklar, R., Hudson, A., Brown, R., In vitro Cellular and Developmental Biology 1991; 27A:433–434). The quiescent cells were treated with the indicated agents (rhGGF2 conditioned media, PDGF with and without methylprednisolone, and control media) in the presence of 10 µM BrdU, 0.5% FCS in DMEM. After two days the cells were fixed in 4% paraformaldehyde in PBS for 30 minutes, and washed with 70% ethanol. The cells were then incubated with an anti-BrdU antibody, washed, and antibody binding was visualized with a peroxidase reaction. The number of staining nuclei were then quantified per area. The results show that GGF2 induces an increase in the number of labelled nuclei per area over controls (see Table 2).

TABLE 2

Mitogenic Effects of GGF on Human Myoblasts

| Treatment | Labelled Nuclei/cm$^2$ | T-Test p value |
|---|---|---|
| Control | 120 ± 22.4 | |
| Infected Control | 103 ± 11.9 | |
| GGF 5 µl/ml | 223 ± 33.8 | 0.019 |
| PDGF 20 ng/ml | 418 ± 45.8 | 0.0005 |
| IGFI 30 ng/ml | 280 ± 109.6 | 0.068 |
| Methylprednisolone 1.0 µM | 142 ± 20.7 | 0.293 |

Platelet derived growth factor (PDGF) was used as a positive control. Methylprednisolone (a corticosteroid) was also used in addition to rhGGF2 and showed no significant increase in labelling of DNA.

rhGGF2 purified to homogeneity (>95% pure) is also mitogenic for human myoblasts (FIG. 1).

Recombinant human GGF2 also causes mitogenesis of primary human myoblasts (see Table 2 and FIG. 1). The mitogenesis assay is performed as described above. The mitotic index is then calculated by dividing the number of BrdU positive cells by the total number of cells.

EXAMPLE 3

Effect of rhGGF2 on Muscle Cell Differentiation

Figure 2:
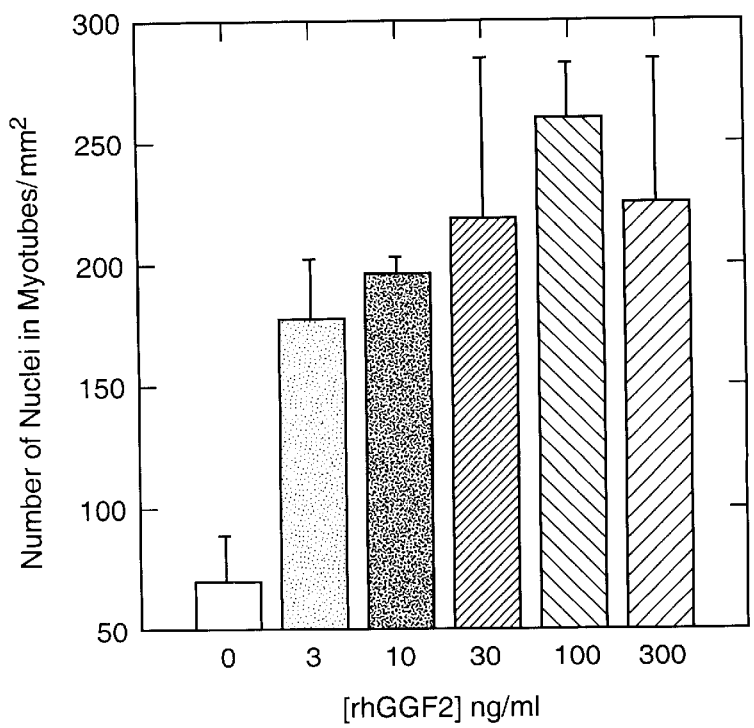
FIG. 2 is a graph showing the effect of rhGGF2 on the number of nuclei in myotubes.

The effects of purified rhGGF2 (95% pure) on muscle culture differentiation were examined (FIG. 2). Confluent myoblast cultures were induced to differentiate by lowering the serum content of the culture medium from 20% to 0.5%. The test cultures were treated with the indicated concentration of rhGGF2 for six days, refreshing the culture medium every 2 days. The cultures were then fixed, stained, and the number of nuclei counted per millimeter. The data in FIG. 2 demonstrate a large increase in the number of nuclei in myotubes when rhGGF2 is present, relative to controls.

EXAMPLE 4

Effect of rhGGF2 on the Survival of Differentiated Myotubes

Figure 3:
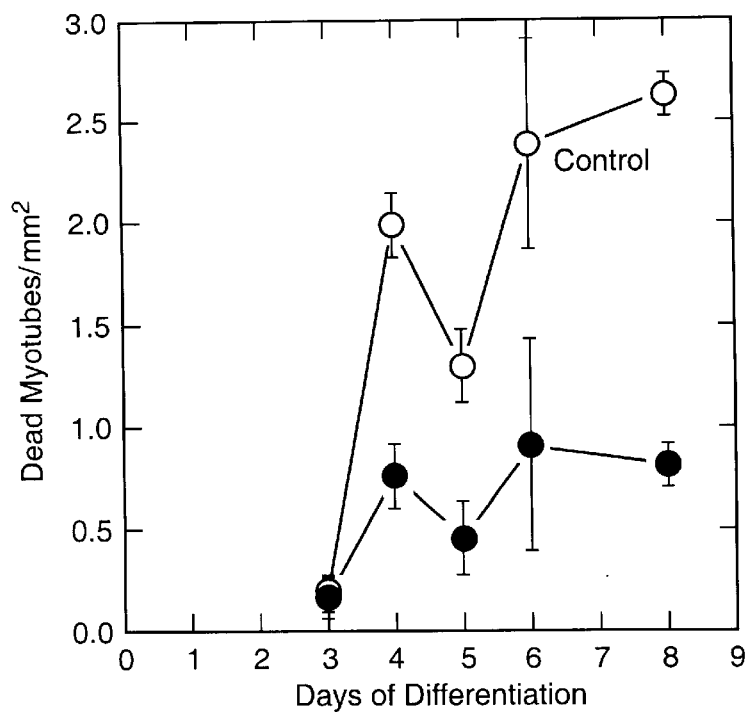
FIG. 3 is a graph of a survival assay showing the effect of rhGGF2 on survival of differentiated myotubes.

The survival of differentiated myotubes was significantly increased by rhGGF2 treatment. Muscle cultures were differentiated in the presence of rhGGF2 and at various times the number of dead myotubes were counted by propidium iodide staining. As can be seen in FIG. 3, the number of dead myotubes is lower in the rhGGF2 treated culture at 4, 5, 6, and 8 days of differentiation. The number of nuclei in myotubes was significantly increased by GGF2 treatment compared to untreated cultures after 8 days of differentiation. Specifically, the control showed 8.6 myonuclei/mm$^2$, while rhGGF2 treated cultures showed 57.2 myonuclei/mm$^2$ (p=0.035) when counted on the same plates after geimsa staining.

Figure 4:
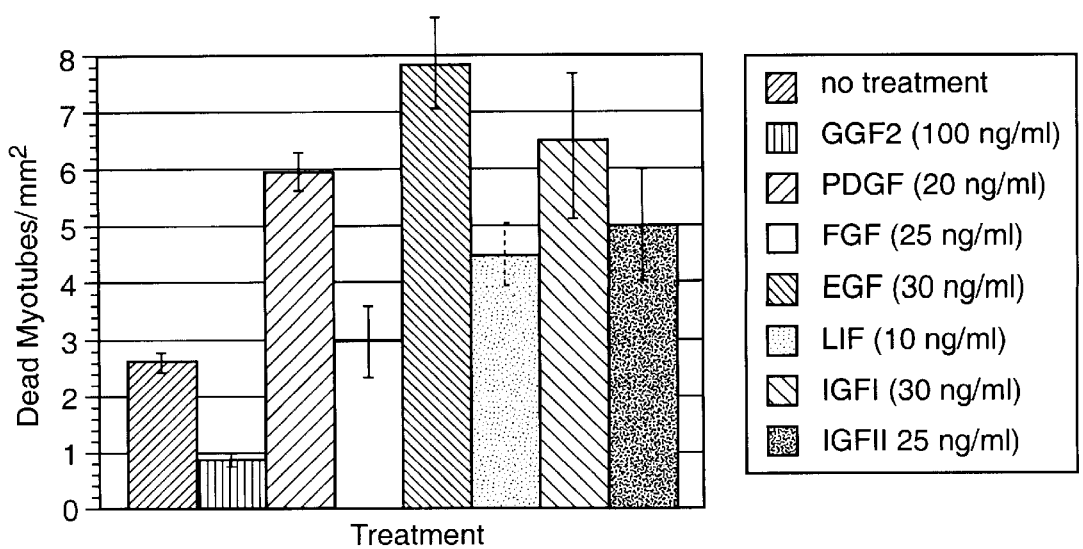
FIG. 4 is a graph of survival assays showing the effect of rhGGF2 on differentiated myotubes relative to human platelet derived growth factor, human fibroblast growth factor, human epidermal growth factor, human leucocyte inhibitory factor, and human insulin-like growth factors I and II.

The survival assay was also performed with other growth factors which have known effects on muscle culture. The rhGGF2 effect was unique among the growth factors tested (FIG. 4). In this experiment cultures were treated in parallel with the rhGGF2 treated plates with the indicated concentrations of the various growth factors. Survival of myotubes was measured as above at 8 days of differentiation of 057A myoblast cells. Concentrations of factors were as follows: rhGGF2: 100 ng/ml; human platelet derived growth factor: 20 ng/ml; human basic fibroblast growth factor: 25 ng/ml; human epidermal growth factor: 30 ng/ml; human leucocyte inhibitory factor: 10 ng/ml; human insulin like growth factor I: 30 ng/ml; human insulin like growth factor II: 25 ng/ml.

The observed protection of differentiated myotubes from death indicates that rhGGF2 has promise as a therapy for intervention of muscle degeneration characterized by numerous muscle diseases. Thus, agents which increase the extramuscular concentration of neuregulins may have a prophylactic effect or slow the progress of muscle-wasting disorders and increase rates of muscle differentiation, repair, conditioning, and regeneration.

Figure 5:
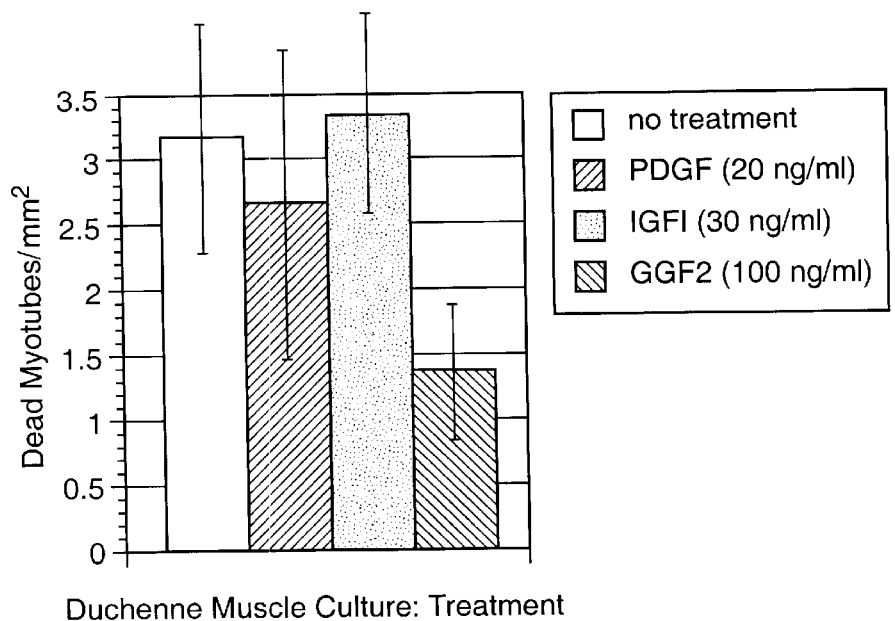
FIG. 5 is a graph showing the increased survival on Duchenne muscular dystrophy cells in the presence of rhGGF2.

EXAMPLE 5 rhGGF2 Promotes Survival of Differentiated Myotubes with a Genetic Defect at the Duchenne Muscular Dystrophy Locus The positive effects of rhGGF2 on myotube survival could reflect potential efficacy in degenerative disorders. These effects on myotube survival were tested on a clonally-derived primary Duchenne myoblast to determine if the response observed in normal muscle culture could also be demonstrated in cultures derived from diseased individuals. The data presented in FIG. 5 was obtained using the same muscle culture conditions (Example 4, above) used for normal individual. rhGGF2 significantly decreased the number of dead myotubes in the differentiated Duchenne muscle culture, compared to controls (p=0.032). Concentrations were as follows: GGF2: 100 ng/ml; human platelet derived growth factor: 20 ng/ml; human insulin like growth factor I: 30 ng/ml.

This example demonstrates that rhGGF2 can also promote survival of differentiated Duchenne myotubes and provides strong evidence that rhGGF2 may slow or prevent the course of muscle degeneration and wasting in mammals.

EXAMPLE 6 rhGGF2 Effect on the Differentiation Program: Induction of MHC Slow and Dystrophin Proteins The effects of purified rhGGF2 on muscle culture differentiation was also examined by Western analysis of culture lysates. The levels of muscle specific proteins were determined in triplicate treated and untreated cultures. These cultures were prepared and treated as above except that the plate size was increased to 150 mm and the muscle culture layer was scraped off for Western analysis as described in Sklar, R., and Brown, R. (*J. Neurol. Sci.* 101:73–81, 1991). The results presented in Table A indicate that rhGGF2 treatment increases the levels of several muscle specific proteins, including dystrophin, myosin heavy chain (MHC, adult slow and fast isoforms), but does not increase the levels of HSP72 or MHC neonate isoform to a similar level per amount of protein loaded on the Western. The levels of muscle specific proteins induced by rhGGF2 were similar to the quantitative increases in the number of myonuclei/mm$^2$ (Table 3).

TABLE 3

|  | Control ± SD | rhGGF2 Treatment ± SD | p value |
|---|---|---|---|
| Total Protein (μg) | 554 ± 38.4 | 798 ± 73.6 | 0.007 |
| Myonuclei/mm$^2$ | 29.0 ± 12.2 | 106 ± 24.1 | 0.008 |
| MHC fast/μg protein | 1.22 ± 0.47 | 4.00 ± 0.40 | 0.001 |
| MHC slow/μg protein | 0.17 ± 0.13 | 1.66 ± 0.27 | 0.001 |
| MHC neonate/μg protein | 0.30 ± 0.27 | 0.55 ± 0.04 | 0.199 |
| dystrophin/μg protein | 6.67 ± 0.37 | 25.5 ± 11.0 | 0.042 |
| HSP 72/μg protein | 3.30 ± 0.42 | 4.54 ± 0.08 | 0.008 |

The rhGGF2 dependent increase in the adult myosin heavy chain isoforms (slow is found in type I human muscle fibers; fast is found in type 2A and 2B human muscle fibers) may represent a maturation of the myotubes, as the neonatal isoform was not significantly increased by rhGGF2 treatment.

During rat muscle development MHC isoforms switch from fetal to neonatal forms followed by a switch to mature adult slow and fast MHC isoforms (Periasamy et al. *J. Biol. Chem.* 259:13573–13578, 1984; Periasamy et al. *J. Biol. Chem.* 260:15856–15862, 1985; Wieczorek et al. *J. Cell Biol.* 101:618–629, 1985). While muscle can autonomously undergo some of these isoform transitions in the absence of neural cells or tissue, mouse muscle explants express the adult fast MHC isoform only when cultured in the presence of mouse spinal cord (Ecob-Prince et al. *J. Cell Biol.* 103:995–1005, 1986). Additional evidence that MHC isoform transitions are influenced by nerve was established by Whalen et al. (*Deve. Biol.* 141:24–40, 1990); after regeneration of notexin treated rat soleus muscles only the adult fast MHC isoform was produced in the new denervated muscle, but innervated regenerated muscle made both fast and slow adult MHC isoforms. Thus the demonstration in Table 3 that rhGGF2 increases the synthesis of adult MHC isoforms indicates that rhGGF2 may induce a developmental maturation of muscle which may mimic neuronal innervation.

EXAMPLE 7

Neuregulins, Including rhGGF2, Induce the Synthesis of Acetylcholine Receptors in Muscle The expression of acetylcholine receptor (AchR) subunit proteins can be induced by exposing muscle cells to neuregulins. More specifically, we have shown that contacting muscle cells with rhGGF2 can induce the synthesis of AchR subunit proteins. This induction following rhGGF2 exposure was observed in two ways: first, we detected increased expression of human growth hormone via the product of a reporter gene construct and second we detected increased binding of alpha-bungarotoxin to cells.

In the following example a mouse myoblast cell line C2 was used. C2 cells were transfected with a transgene that contained the 5' regulatory sequences of the AChR delta subunit gene of mouse linked to a human growth hormone full-length cDNA (Baldwin and Burden, 1988. J. Cell Biol. 107:2271–2279). This reporter construct allows the measurement of the induction of AChR delta gene expression by assaying the quantity of growth hormone secreted into the media. The line can be induced to form myotubes by lowering serum concentration in the media from 20% to 0.5%.

Figure 6:
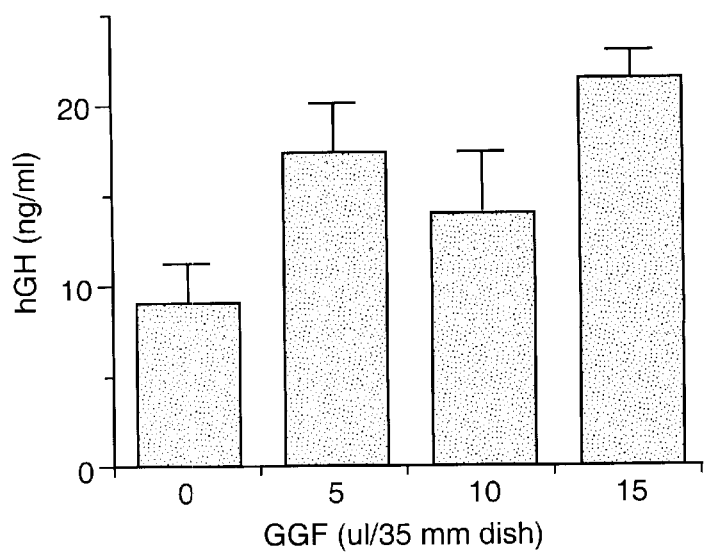
FIG. 6 is a graph of increasing human growth hormone (hGH) expression in C2 cells from an hGH reporter gene under control of the AchR delta subunit transcriptional control elements. This increase is tied to the addition of GGF2 to the media.
Figure 7:
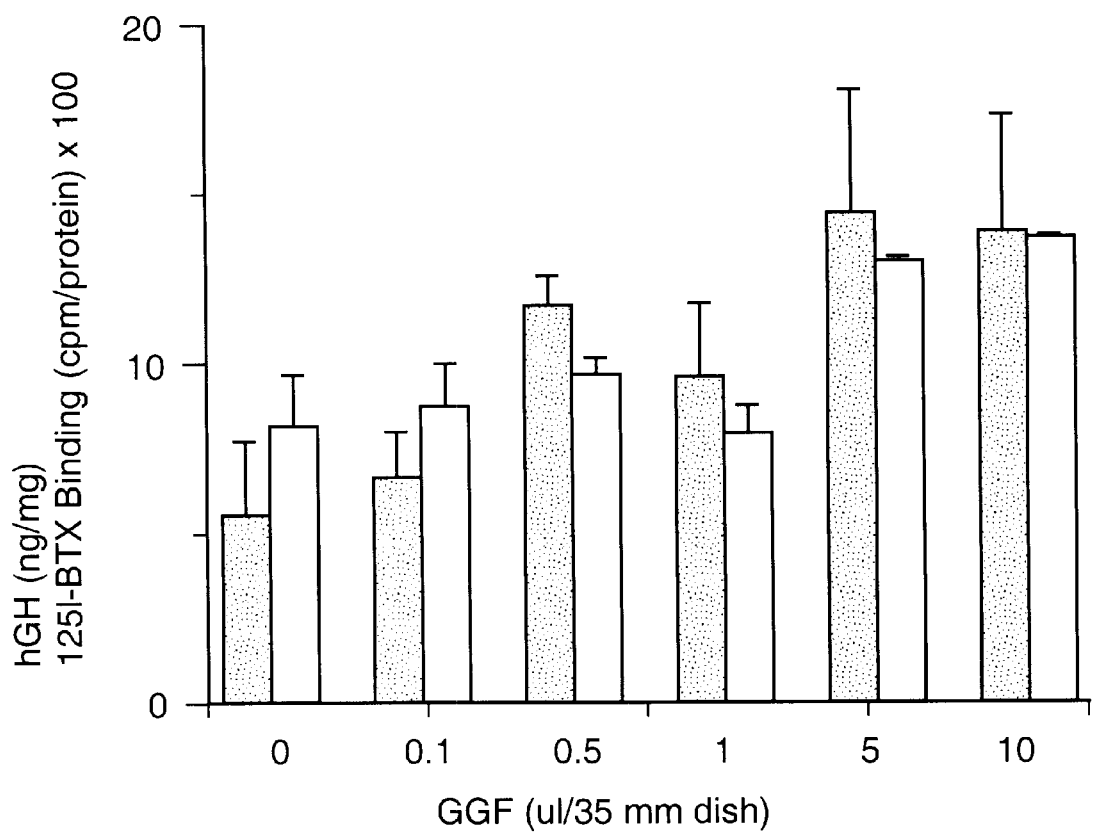
FIG. 7 is a graph of increasing hGH reporter synthesis and bungarotoxin (BTX) binding to AchRs following the addition of increasing amounts of GGF2 to C2 cells.

Specifically, mouse C2 myoblasts transfected with an AChR-human growth hormone reporter construct and were assayed for expression of hGH following treatment with rhGGF2. The results of two separate experiments are summarized in Table 4 and in FIGS. 6 (hGH expression) and 7 (hGH expression and alpha-bungarotoxin binding). Shown are the dose response curves for secreted human growth hormone and for bungarotoxin binding from muscle cultures treated with rhGGF2.

TABLE 4

Effects of rhGGF2 on the expression of AChR delta subunit/hGH transgene and the synthesis of AChR

| GGF (ul) | Exp 1 hGH (ng/ml) | Exp 2 hGH (ng/ml) | AChR (cpm/mg protein) |
|---|---|---|---|
| 0 | 9.3 + 2.1 | 5.7 + 2.1 | 822 + 170 |
| 0.1 | — | 6.8 + 1.5 | 891 + 134 |
| 0.5 | — | 12.0 + 0.9 | 993 + 35 |
| 1.0 | — | 9.7 + 2.3 | 818 + 67 |
| 5.0 | 17.5 + 2.8 | 14.7 + 3.5 | 1300 + 177 |
| 10.0 | 14.3 + 3.2 | 14.1 + 3.3 | 1388 + 137 |
| 15.0 | 22.0 + 1.4 | — | — |

C2 myotubes were treated with cold α-BTX (20 nM) for 1 hr. at 37° C., washed with culture medium twice and then treated with GGF2. Culture medium was adjusted with bovine serum albumin at the concentration of 1 mg/ml. 24 hours later, culture medium was removed and saved for hGH assay. Muscle cultures were treated with $^{125}$I-α-BTX (20 nM) for 1 hour at 37° C., washed and scraped in PBS containing 1% SDS. Non-specific binding was determined in the presence of cold α-BTX (40 nM). The cell homogenate was counted for radioactivity and assayed for total protein amount.

The presence of rhGGF2 led to a greater than 2-fold increase in hGH gene expression, thereby indicating that rhGGF2 induced the synthesis of the delta subunit of the acetylcholine receptor. Furthermore, increased bungarotoxin binding is consistant with assembly of these subunit proteins into functional acetylcholine receptors. To strenthen the interpretation of these data the analysis was repeated on cultures that had the hGH reporter linked to a metallothiene promotor, which should not be responsive to rhGGF2. The results of that control experiment showed that the hGH response was mediated through transcriptional activation of the AchR delta subunit gene control elements.

These results indicate that rhGGF2 could be useful in replenishing AchRs as part of the therapy for the autoimmune disease Myasthenia gravis. This activity may also be beneficial in treatment of peripheral nerve regeneration and neuropathy by stimulating a key step in reinnervation of muscle.

EXAMPLE 8

Additional Mitogenic Activities of Purified GGF-I and GGF-II

The mitogenic activity of a highly purified sample containing both GGFs I and II was studied using a quantitative method, which allows a single microculture to be examined for DNA synthesis, cell morphology, cell number and expression of cell antigens. This technique has been modified from a method previously reported by Muir et al., Analytical Biochemistry 185, 377–382, 1990. The main modifications are: 1) the use of uncoated microtiter plates, 2) the cell number per well, 3) the use of 5% Foetal Bovine Plasma (FBP) instead of 10% Foetal Calf Serum (FCS), and 4) the time of incubation in presence of mitogens and bromodeoxyuridine (BrdU), added simultaneously to the cultures. In addition the cell monolayer was not washed before fixation to avoid loss of cells, and the incubation time of monoclonal mouse anti-BrdU antibody and peroxidase conjugated goat anti-mouse immunoglobulin (IgG) antibody were doubled to increase the sensitivity of the assay. The assay, optimized for rat sciatic nerve. Schwann cells, has also been used for several cell lines, after appropriate modifications to the cell culture conditions.

I. Methods of Mitogenesis Testing

On day 1, purified Schwann cells were plated onto uncoated 96 well plates in 5% FBP/Dulbecco's Modified Eagle Medium (DMEM) (5,000 cells/well). On day 2, GGFs or other test factors were added to the cultures, as well as BrdU at a final concentration of 10 Am. After 48 hours (day 4) BrdU incorporation was terminated by aspirating the medium and cells were fixed with 200 μl/well of 70% ethanol for 20 min at room temperature. Next, the cells were washed with water and the DNA denatured by incubation with 100 μl 2N HCl for 10 min at 37° C. Following aspiration, residual acid was neutralized by filling the wells with 0.1 M borate buffer, pH 9.0, and the cells were washed with phosphate buffered saline (PBS). Cells were then treated with 50 μl of blocking buffer (PBS containing 0.1% Triton X 100 and 2% normal goat serum) for 15 min at 37° C. After aspiration, monoclonal mouse anti-BrdU antibody (Dako Corp., Santa Barbara, Calif.) (50 μl/well, 1.4 μg/ml diluted in blocking buffer) was added and incubated for two hours at 37° C. Unbound antibodies were removed by three washes in PBS containing 0.1% Triton X-100 and peroxidase-conjugated goat anti-mouse IgG antibody (Dako Corp., Santa Barbara, Calif.) (50 μl/well, 2 μg/ml diluted in blocking buffer) was added and incubated for one hour at 37° C. After three washes in PBS/Triton and a final rinse in PBS, wells received 100 μl/well of 50 mM phosphate/citrate buffer, pH 5.0, containing 0.05% of the soluble chromogen o-phenylenediamine (OPD) and 0.02% $H_2O_2$. The reaction was terminated after 5–20 min at room temperature, by pipetting 80 μl from each well to a clean plate containing 40 μl/well of 2N sulfuric acid. The absorbance was recorded at 490 nm using a plate reader (Dynatech Labs). The assay plates containing the cell monolayers were washed twice with PBS and immunocytochemically stained for BrdU-DNA by adding 100 μl/well of the substrate diaminobenzidine (DAB) and 0.02% $H_2O_2$ to generate an insoluble product. After 10–20 min the staining reaction was stopped by washing with water, and BrdU-positive nuclei observed and counted using an inverted microscope. occasionally, negative nuclei were counterstained with 0.001% Toluidine blue and counted as before.

II. Cell Lines Used for Mitogenesis Assays

Swiss 3T3 Fibroblasts: Cells, from Flow Labs, were maintained in DMEM supplemented with 10% FCS, penicillin and streptomycin, at 37° C. in a humidified atmosphere of 10% $CO_2$ in air. Cells were fed or subcultured every two days. For mitogenic assay, cells were plated at a density of 5,000 cells/well in complete medium and incubated for a week until cells were confluent and quiescent. The serum containing medium was removed and the cell monolayer washed twice with serum free-medium. 100 μl of serum free medium containing mitogens and 10 μM of BrdU were added to each well and incubated for 48 hours. Dose responses to GGFs and serum or PDGF (as a positive control) were performed.

BHK (Baby Hamster Kidney) 21 C13 Fibroblasts: Cells from European Collection of Animal Cell Cultures (ECACC), were maintained in Glasgow Modified Eagle Medium (GMEM) supplemented with 5% tryptose phosphate broth, 5% FCS, penicillin and streptomycin, at 37° C. in a humidified atmosphere of 5% $CO_2$ in air. Cells were fed or subcultured every two to three days. For mitogenic assay, cells were plated at a density of 2,000 cell/well in complete medium for 24 hours. The serum containing medium was then removed and after washing with serum free medium, replaced with 100 μl of 0.1% FCS containing GMEM or GMEM alone. GGFs and FCS or bFGF as positive controls were added, coincident with 10 μM BrdU, and incubated for 48 hours. Cell cultures were then processed as described for Schwann cells.

C6 Rat Glioma Cell Line: Cells, obtained at passage 39, were maintained in DMEM containing 5% FCS, 5% Horse serum (HS), penicillin and streptomycin, at 37° C. in a humidified atmosphere of 10% $CO_2$ in air. Cells were fed or subcultured every three days. For mitogenic assay, cells were plated at a density of 2,000 cells/well in complete medium and incubated for 24 hours. Then medium was replaced with a mixture of 1:1 DMEM and F12 medium containing 0.1% FCS, after washing in serum free medium. Dose responses to GGFs, FCS and AFGF were then performed and cells were processed through the ELISA as previously described for the other cell types.

PC12 (Rat Adrenal Pheochromocytoma Cells): Cells from ECACC, were maintained in RPMI 1640 supplemented with 10% HS, 5% FCS, penicillin and streptomycin, in collagen coated flasks, at 37° C. in a humidified atmosphere of 5% $CO_2$ in air. Cells were fed every three days by replacing 80% of the medium. For mitogenic assay, cells were plated at a density of 3,000 cells/well in complete medium, on collagen coated plates (50 μl/well collagen, Vitrogen Collagen Corp., diluted 1:50, 30 min at 37° C.) and incubated for 24 hours. The medium was then placed with fresh RPMI either alone or containing 1 mM insulin or 1% FCS. Dose responses to FCS/HS (1:2) as positive control and to GGFs were performed as before. After 48 hours cells were fixed and the ELISA performed as previously described.

III. Results of Mitogenesis Assays

All the experiments presented in this Example were performed using a highly purified sample from a Sepharose 12 chromatography purification step containing a mixture of GGF-I and GGF-II (GGFs).

First, the results obtained with the BrdU incorporation assay were compared with the classical mitogenic assay for Schwann cells based on [125]I-UdR incorporation into DNA of dividing cells, described by J. P. Brockes (*Methods Enzymol.* 147:217, 1987).

Figure 12:
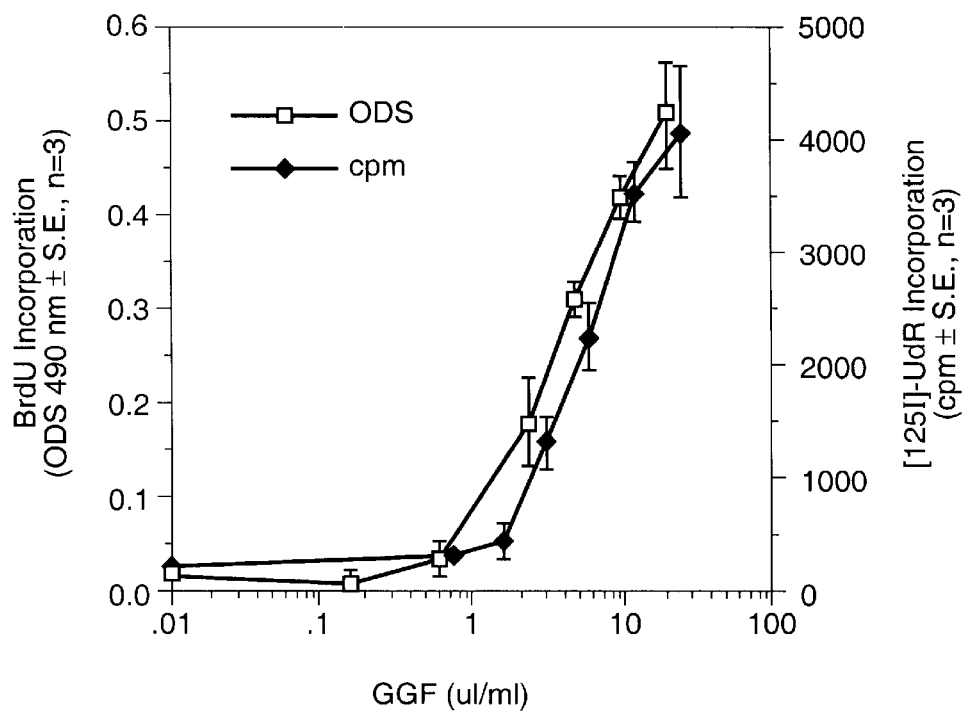

FIG. 12 shows the comparison of data obtained with the two assays, performed in the same cell culture conditions (5,000 cells/well, in 5% FBP/DMEM, incubated in presence of GGFs for 48 hrs). As clearly shown, the results are comparable, but BrdU incorporation assay appears to be slightly more sensitive, as suggested by the shift of the curve to the left of the graph, i.e. to lower concentrations of GGFS.

As described under the section "Methods of Mitogenesis Testing", after the immunoreactive BrdU-DNA has been quantitated by reading the intensity of the soluble product of the OPD peroxidase reaction, the original assay plates containing cell monolayers can undergo the second reaction resulting in the insoluble DAB product, which stains the BrdU positive nuclei. The microcultures can then be examined under an inverted microscope, and cell morphology and the numbers of BrdU-positive and negative nuclei can be observed.

Figure 13A:
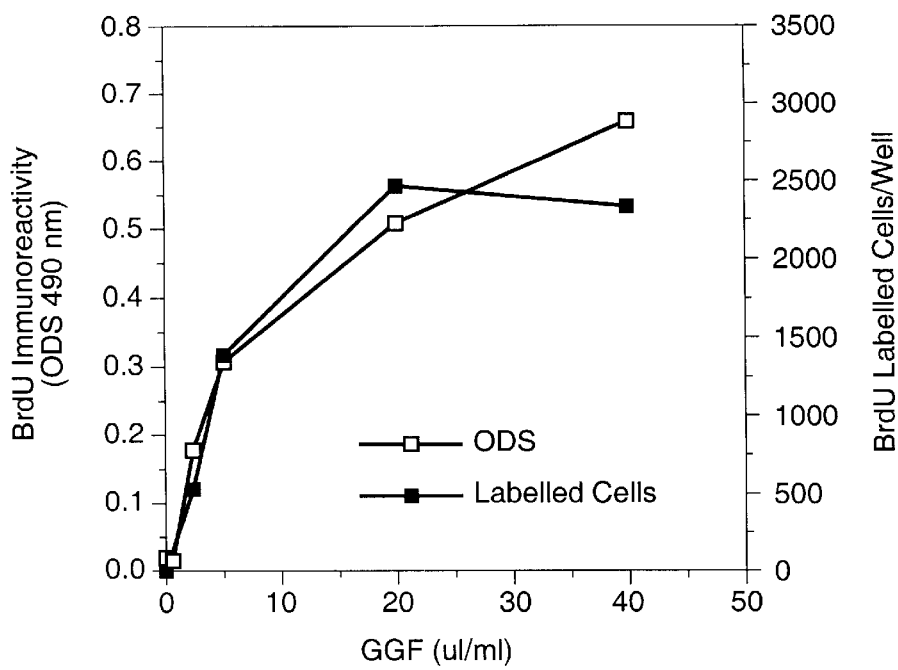
Figure 13B:
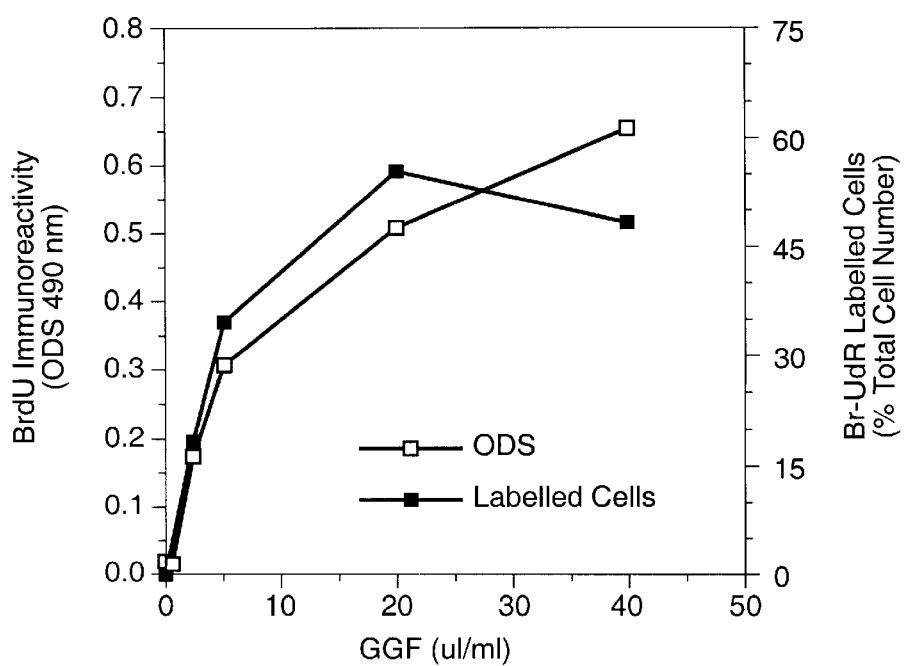
Figure 14:
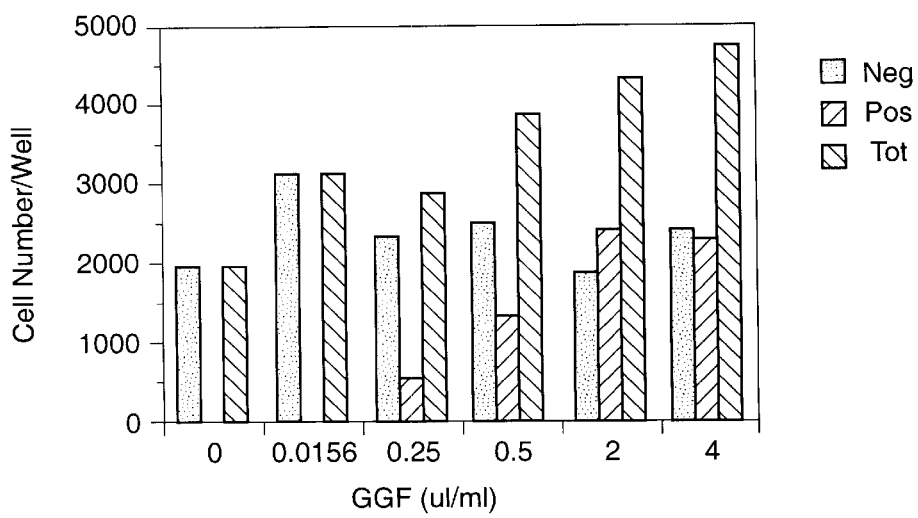

In FIG. 13A and FIG. 13B the BrdU-DNA immunoreactivity, evaluated by reading absorbance at 490 nm, is compared to the number of BrdU-positive nuclei and to the percentage of BrdU-positive nuclei on the total number of cells per well, counted in the same cultures. Standard deviations were less than 10%. The two evaluation methods show a very good correlation and the discrepancy between the values at the highest dose of GGFs can be explained by the different extent of DNA synthesis in cells detected as BrdU-positive.

Figure 15:
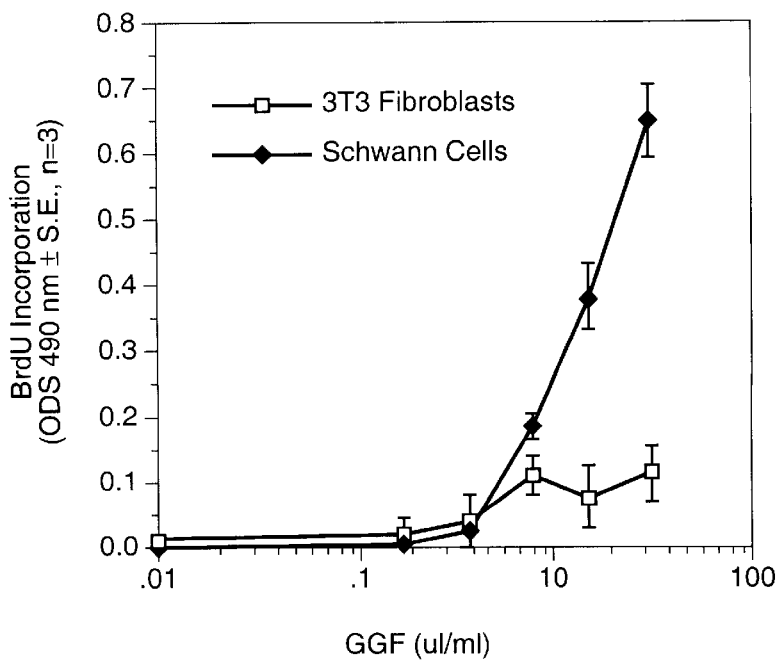

The BrdU incorporation assay can therefore provide additional useful information about the biological activity of polypeptides on Schwann cells when compared to the (125) I-UdR incorporation assay. For example, the data reported in FIG. 15 show that GGFs can act on Schwann cells to induce DNA synthesis, but at lower doses to increase the number of negative cells present in the microculture after 48 hours.

The assay has then been used on several cell lines of different origin. In FIG. 15 the mitogenic responses of Schwann cells and Swiss 3T3 fibroblasts to GGFs are compared; despite the weak response obtained in 3T3 fibroblasts, some clearly BrdU-positive nuclei were detected in these cultures. Control cultures were run in parallel in presence of several doses of FCS or human recombinant PDGF, showing that the cells could respond to appropriate stimuli (not shown).

Figure 16:
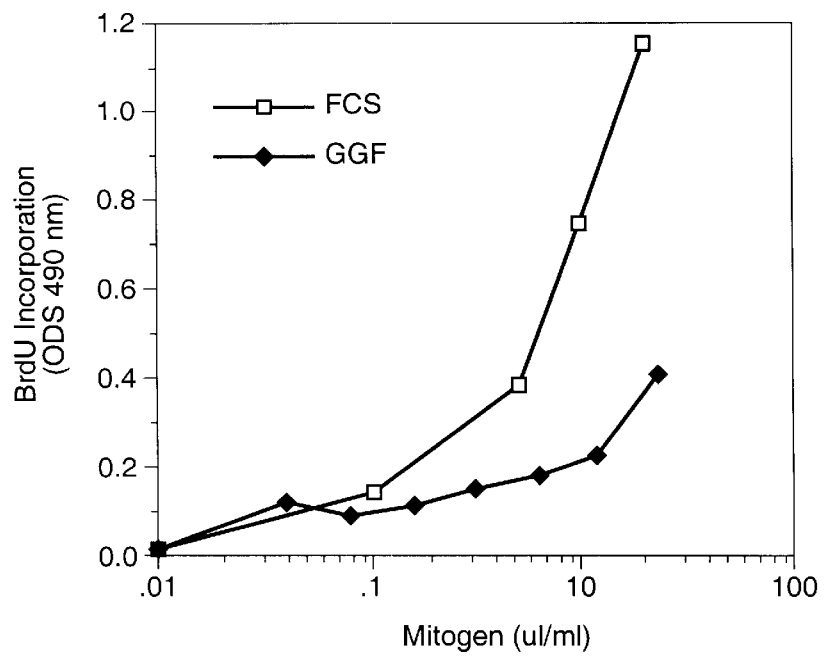
Figure 17:
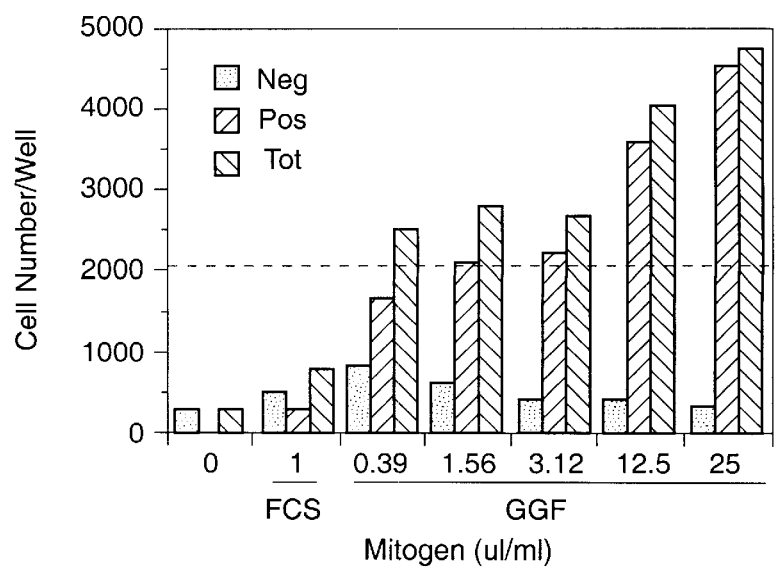

The ability of fibroblasts to respond to GGFs was further investigated using the BHK 21 C13 cell line. These fibroblasts, derived from kidney, do not exhibit contact inhibition or reach a quiescent state when confluent. Therefore the experimental conditions were designed to have a very low background proliferation without compromising the cell viability. GGFs have a significant mitogenic activity on BHK21 C13 cells as shown by FIG. 16 and FIG. 17. FIG. 16 shows the Brdu incorporation into DNA by BHK 21 C13 cells stimulated by GGFS in the presence of 0.1% FCS. The good mitogenic response to FCS indicates that cell culture conditions were not limiting. In FIG. 17 the mitogenic effect of GGFs is expressed as the number of BrdU-positive and BrdU-negative cells and as the total number of cells counted per well. Data are representative of two experiments run in duplicates; at least three fields per well were counted. As observed for Schwann cells in addition to a proliferative effect at low doses, GGFs also increase the numbers of nonresponding cells surviving. The percentage of BrdU positive cells is proportional to the increasing amounts of GGFs added to the cultures. The total number of cells after 48 hours in presence of higher doses of GGFs is at least doubled, confirming that GGFs induce DNA synthesis and proliferation in BHK21 C13 cells. Under the same conditions, cells maintained for 48 hours in the presence of 2% FCS showed an increase of about six fold (not shown).

Figure 18:
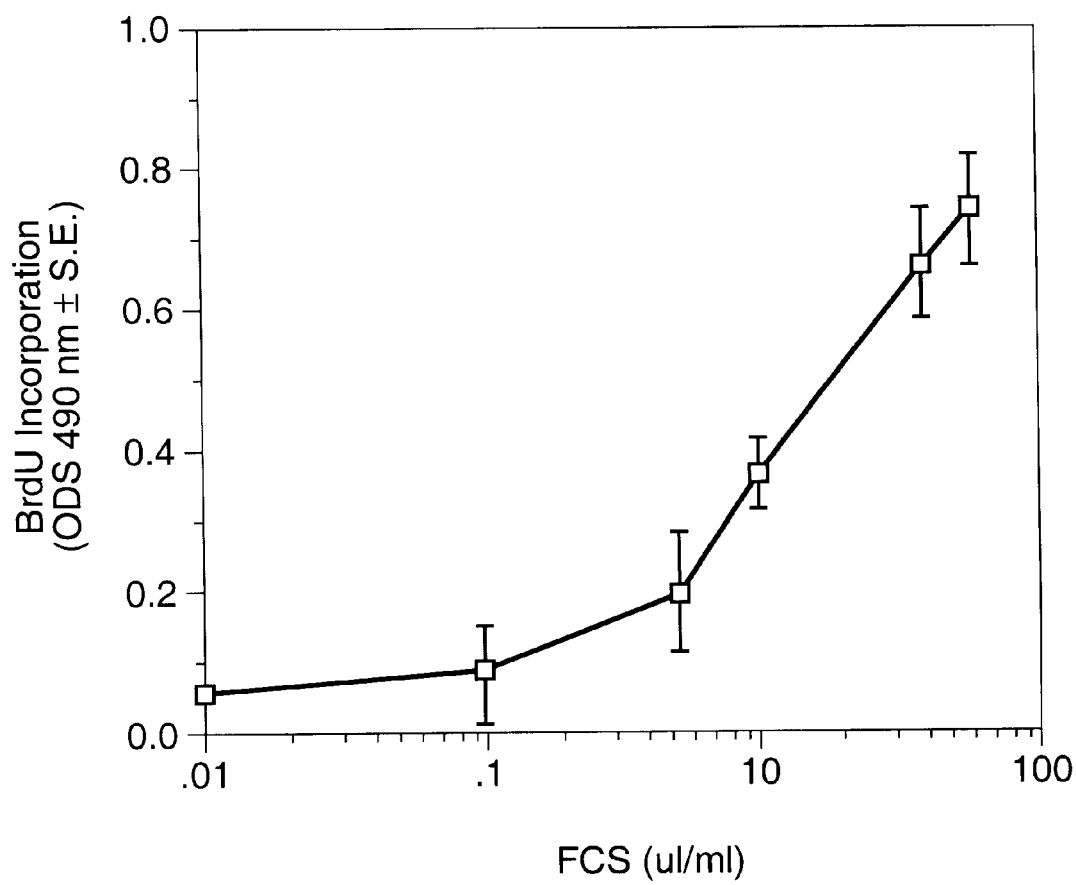
Figure 23:
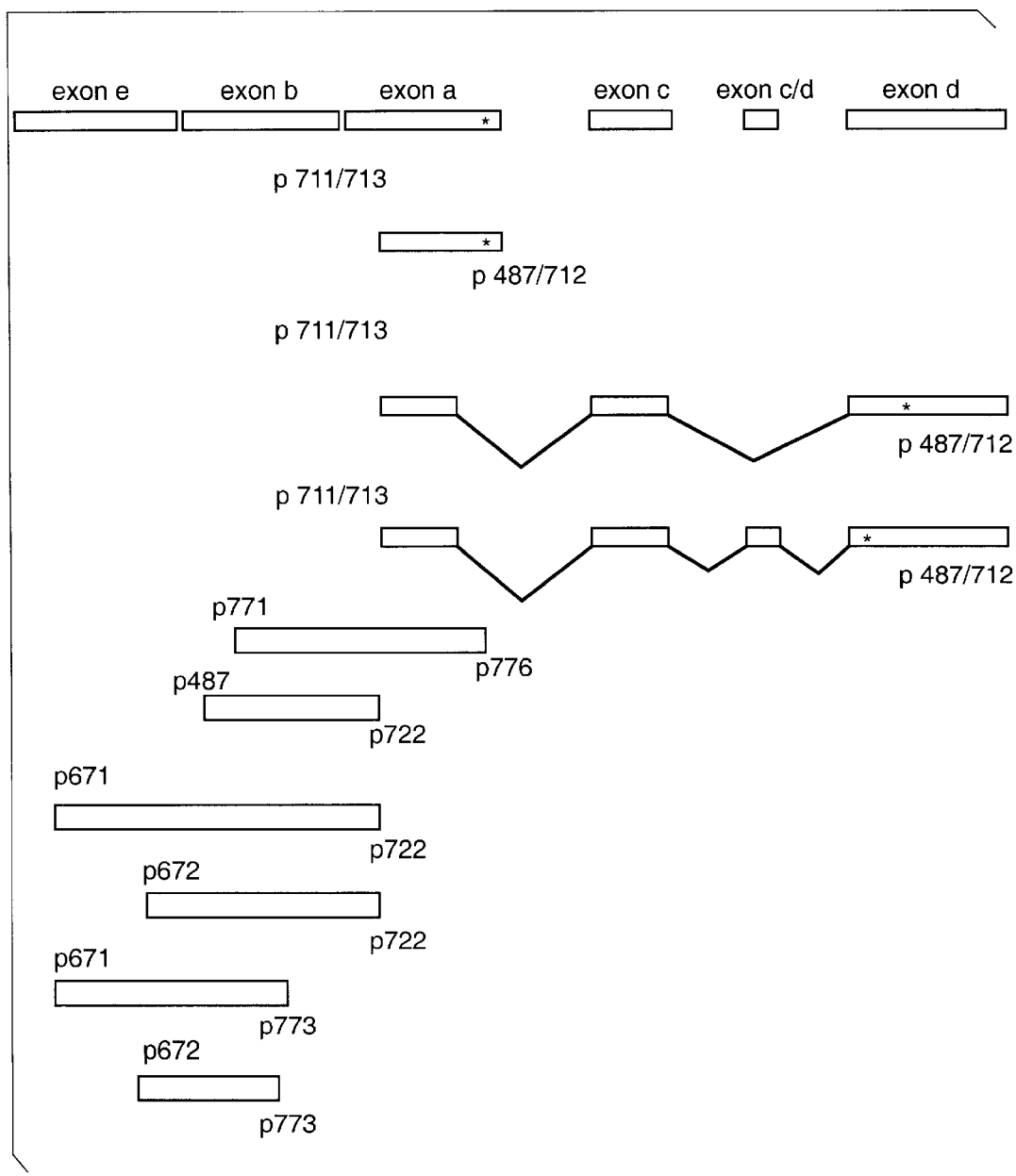
Figure 24:
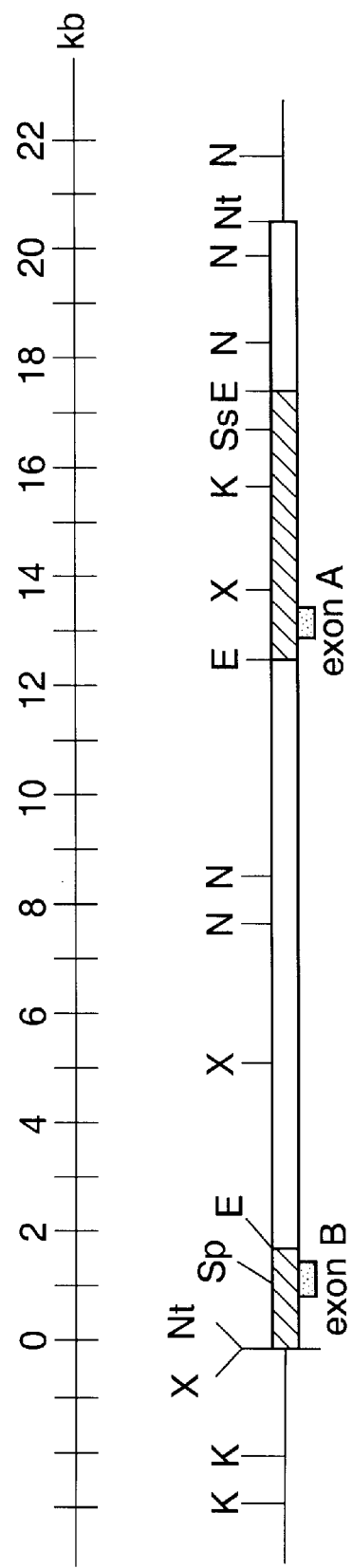
Figure 25:
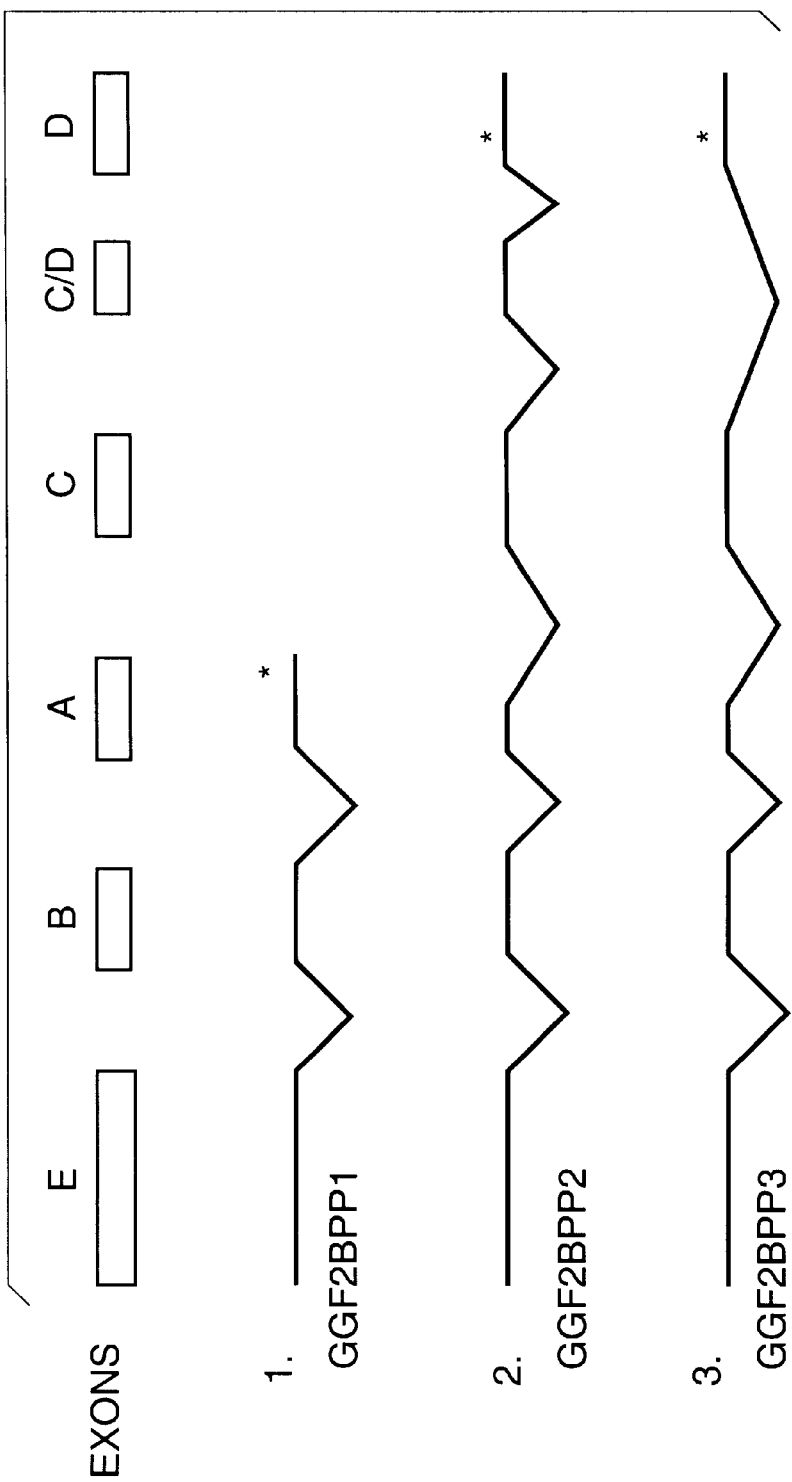

C6 glioma cells have provided a useful model to study glial cell properties. The phenotype expressed seems to be dependent on the cell passage, the cells more closely resembling an astrocyte phenotype at an early stage, and an oligodendrocyte phenotype at later stages (beyond passage 70). C6 cells used in these experiments were from passage 39 to passage 52. C6 cells are a highly proliferating population, therefore the experimental conditions were optimized to have a very low background of BrdU incorporation. The presence of 0.1% serum was necessary to maintain cell viability without significantly affecting the mitogenic responses, as shown by the dose response to FCS (FIG. 18).

In FIG. 19 the mitogenic responses to aFGF (acidic Fibroblast growth factor) and GGFs are expressed as the percentages of maximal BrdU incorporation obtained in the presence of FCS (8%). Values are averages of two experiments, run in duplicates. The effect of GGFs was comparable to that of a pure preparation of aFGF. aFGF has been described as a specific growth factor for C6 cells (Lim R. et al., Cell Regulation 1:741–746, 1990) and for that reason it was used as a positive control. The direct counting of BrdU positive and negative cells was not possible because of the high cell density in the microcultures. In contrast to the cell lines so far reported, PC12 cells did not show any evident responsiveness to GGFS, when treated under culture conditions in which PC12 could respond to sera (mixture of FCS and HS as used routinely for cell maintenance). Nevertheless the number of cells plated per well seems to affect the behavior of PC12 cells, and therefore further experiments are required.

EXAMPLE 9

Amino Acid Sequences of Purified GGF-I and GGF-II

Amino acid sequence analysis studies were performed using highly purified bovine pituitary GGF-I and GGF-II. The conventional single letter code was used to describe the sequences. Peptides were obtained by lysyl endopeptidase and protease V8 digests, carried out on reduced and carboxymethylated samples, with the lysyl endopeptidase digest of GGF-II carried out on material eluted from the 55–65 RD region of a 11% SDS-PAGE (MW relative to the above-quoted markers).

A total of 21 peptide sequences (see FIG. 8, SEQ ID Nos. 1–20, and 29) were obtained for GGF-I, of which 12 peptides (see FIG. 9, SEQ ID Nos. 1, 22–29, 17, 19, and 32) are not present in current protein databases and therefore represent unique sequences. A total of 12 peptide sequences (see FIG. 10, SEQ ID NOs: 33–39, 51–52, and 164–166) were obtained for GGF-II, of which 10 peptides (see FIG. 11, SEQ ID NOs: 45–53) are not present in current protein databases and therefore represent unique sequences (an exception is peptide GGF-II 06 which shows identical sequences in many proteins which are probably of no significance given the small number of residues). These novel sequences are extremely likely to correspond to portions of the true amino acid sequences of GGFs I and II.

Particular attention can be drawn to the sequences of GGF-I 07 and GGF-II 12, which are clearly highly related. The similarities indicate that the sequences of these peptides are almost certainly those of the assigned GGF species, and are most unlikely to be derived from contaminant proteins.

In addition, in peptide GGF-II 02, the sequence X S S is consistent with the presence of an N linked carbohydrate moiety on an asparagine at the position denoted by X.

In general, in FIGS. 8 and 10, X represents an unknown residue denoting a sequencing cycle where a single position could not be called with certainty either because there was more than one signal of equal size in the cycle or because no signal was present. As asterisk denotes those peptides where the last amino acid called corresponds to the last amino acid present in that peptide. In the remaining peptides, the signal strength after the last amino acid called was insufficient to continue sequence calling to the end of that peptide. The right hand column indicates the results of a computer database search using the GCG package FASTA and TFASTA programs to analyze the NBRF and EMBL sequence databases. The name of a protein in this column denotes identity of a portion of its sequence with the peptide amino acid sequence called allowing a maximum of two mismatches. A question mark denotes three mismatches allowed. The abbreviations used are as follows:

HMG-1 High Mobility Group protein-1
HMG-2 High Mobility Group protein-2
LH-alpha Luteinizing hormone alpha subunit
LH-beta Luteinizing hormone beta subunit

EXAMPLE 10

Isolating and Cloning of Nucleotide Sequences Encoding Proteins Containing GGF-T and GGF-TT Peptides Isolation and cloning of the GGF-II nucleotide sequences was performed as outlined herein, using peptide sequence information and library screening, and was performed as set out below. It will be appreciated that the peptides of FIGS. 10 and 11 can be used as the starting point for isolation and cloning of GGF-I sequences by following the techniques described herein. Indeed, FIG. 20, SEQ ID NOs: 54–76 and 78–88) shows possible degenerate oligonucleotide probes for this purpose, and FIG. 22, SEQ ID NOs:90–119, lists possible PCR primers. DNA sequence and polypeptide sequence should be obtainable by this means as with GGF-II, and also DNA constructs and expression vectors incorporating such DNA sequence, host cells genetically altered by incorporating such constructs/vectors, and protein obtainable by cultivating such host cells. The invention envisages such subject matter.

I. Design and Synthesis of Oligonucleotide Probes and Primers

Degenerate DNA oligomer probes were designed by backtranslating the amino acid sequences (derived from the peptides generated from purified GGF protein) into nucleotide sequences. Oligomers represented either the coding strand or the non-coding strand of the DNA sequence. When serine, arginine or leucine were included in the oligomer design, then two separate syntheses were prepared to avoid ambiguities. For example, serine was encoded by either TCN or AGY as in 537 and 538 or 609 and 610. Similar codon splitting was done for arginine or leucine (e.g. 544, 545). DNA oligomers were synthesized on a Biosearch 8750 4-column DNA synthesizer using β-cyanoethyl chemistry operated at 0.2 micromole scale synthesis. Oligomers were cleaved off the column (500 angstrom CpG resins) and deprotected in concentrated ammonium hydroxide for 6–24 hours at 55–60° C. Deprotected oligomers were dried under vacuum (Speedvac) and purified by electrophoresis in gels of 15% acrylamide (20 mono : 1 bis), 50 mM Tris-borate-EDTA buffer containing 7M urea. Full length oligomers were detected in the gels by UV shadowing, then the bands were excised and DNA oligomers eluted into 1.5 mls H2O for 4–16 hours with shaking. The eluate was dried, redissolved in 0.1 ml H$_2$O and absorbance measurements were taken at 260 nm.

Concentrations were determined according to the following formula:

(A 260×units/ml)(60.6/length=x μM)

All oligomers were adjusted to 50 μM concentration by addition of H$_2$O.

Degenerate probes designed as above are shown in FIG. 20, SEQ ID NOs: 54–76 and 78–88.

PCR primers were prepared by essentially the same procedures that were used for probes with the following modifications. Linkers of thirteen nucleotides containing restriction sites were included at the 5' ends of the degenerate oligomers for use in cloning into vectors. DNA synthesis was performed at 1 micromole scale using 1,000 angstrom CpG resins and inosine was used at positions where all four nucleotides were incorporated normally into degenerate probes. Purifications of PCR primers included an ethanol precipitation following the gel electrophoresis purification.

II. Library Construction and Screening

A bovine genomic DNA library was purchased from Stratagene (Catalogue Number: 945701). The library contained 2×10$^6$ 15–20 kb Sau3Al partial bovine DNA fragments cloned into the vector lambda DashII. A bovine total brain cDNA library was purchased from Clonetech (Catalogue Number: BL 10139). Complementary DNA libraries were constructed (In Vitrogen; Stratagene) from mRNA prepared from bovine total brain, from bovine pituitary and from bovine posterior pituitary. In Vitrogen prepared two cDNA libraries: one library was in the vector lambda g10, the other in vector pcDNAI (a plasmid library). The Stratagene libraries were prepared in the vector lambda unizap. Collectively, the cDNA libraries contained 14 million primary recombinant phage.

The bovine genomic library was plated on E. coli K12 host strain LE392 on 23×23 cm plates (Nunc) at 150,000 to 200,000 phage plaques per plate. Each plate represented approximately one bovine genome equivalent. Following an overnight incubation at 37° C., the plates were chilled and replicate filters were prepared according to procedures of Maniatis et al. (2:60–81). Four plaque lifts were prepared from each plate onto uncharged nylon membranes (Pall Biodyne A or MSI Nitropure). The DNA was immobilized onto the membranes by cross-linking under UV light for 5 minutes or, by baking at 80° C. under vacuum for two hours. DNA probes were labelled using T4 polynucleotide kinase (New England Biolabs) with gamma 32P ATP (New England Nuclear; 6500 Ci/mmol) according to the specifications of the suppliers. Briefly, 50 pmols of degenerate DNA oligomer were incubated in the presence of 600 μCi gamma $^{32}$P-ATP and 5 units T4 polynucleotide kinase for 30 minutes at 37° C. Reactions were terminated, gel electrophoresis loading buffer was added and then radiolabelled probes were purified by electrophoresis. 32P labelled probes were excised from gel slices and eluted into water. Alternatively, DNA probes were labelled via PCR amplification by incorporation of α-32P-dATP or α-32P dCTP according to the protocol of Schowalter and Sommer, Anal. Biochem 177:90–94 (1989). Probes labelled in PCR reactions were purified by desalting on Sephadex G-150 columns.

Prehybridization and hybridization were performed in GMC buffer (0.52 M NaPi, 7% SDS, 1% BSA, 1.5 mM EDTA, 0.1 M NaCl 10 mg/ml tRNA). Washing was performed in oligowash (160 ml 1 M Na$_2$HPO$_4$, 200 ml 20% SDS, 8.0 ml 0.5 M EDTA, 100 ml 5M NaCl, 3632 ml H2O). Typically, 20 filters (400 sq. centimeters each) representing replicate copies of ten bovine genome equivalents were incubated in 200 ml hybridization solution with 100 pmols of degenerate oligonucleotide probe (128–512 fold degenerate). Hybridization was allowed to occur overnight at 5° C. below the minimum melting temperature calculated for the degenerate probe. The calculation of minimum melting temperature assumes 2° C. for an AT pair and 4° C. for a GC pair.

Filters were washed in repeated changes of oligowash at the hybridization temperatures four to five hours and finally, in 3.2M tetramethylammonium chloride, 1% SDS twice for 30 min at a temperature dependent on the DNA probe length. For 20mers, the final wash temperature was 60° C. Filters were mounted, then exposed to X-ray film (Kodak XAR5) using intensifying screens (Dupont Cronex Lightening Plus). Usually, a three to five day film exposure at minus 80° C. was sufficient to detect duplicate signals in these library screens. Following analysis of the results, filters could be stripped and reprobed. Filters were stripped by incubating through two successive cycles of fifteen minutes in a microwave oven at full power in a solution of 1% SDS containing 10 mM EDTA pH8. Filters were taken through at least three to four cycles of stripping and reprobing with various probes.

III. Recombinant Phage Isolation, Growth and DNA Preparation

These procedures followed standard protocol as described in Recombinant DNA (Maniatis et al 2:60–2:81).

IV. Analysis of Isolated Clones Using DNA Digestion and Southern Blots

Recombinant Phage DNA samples (2 micrograms) were digested according to conditions recommended by the restriction endonuclease supplier (New England Biolabs). Following a four hour incubation at 37° C., the reactions products were precipitated in the presence of 0.1M sodium acetate and three volumes of ethanol. Precipitated DNA was collected by centrifugation, rinsed in 75% ethanol and dried. All resuspended samples were loaded onto agarose gels (typically 1% in TAE buffer; 0.04M Tris acetate, 0.002M EDTA). Gel runs were at 1 volt per centimeter from 4 to 20 hours. Markers included lambda Hind III DNA fragments and/or ØX174HaeIII DNA fragments (New England Biolabs). The gels were stained with 0.5 micrograms/ml of ethidium bromide and photographed. For southern blotting, DNA was first depurinated in the gel by treatment with 0.125 N HCl, denatured in 0.5 N NaOH and transferred in 20×SSC (3M sodium chloride, 0.03 M sodium citrate) to uncharged nylon membranes. Blotting was done for 6 hours up to 24 hours, then the filters were neutralized in 0.5 Tris HCl pH 7.5, 0.15 M sodium chloride, then rinsed briefly in 50 mM Tris-borate EDTA.

For cross-linking, the filters were wrapped first in transparent plastic wrap, then the DNA side exposed for five minutes to an ultraviolet light. Hybridization and washing was performed as described for library screening (see section 2 of this Example). For hybridization analysis to determine whether similar genes exist in other species slight modifications were made. The DNA filter was purchased from Clonetech (Catalogue Number 7753-1) and contains 5 micrograms of EcoRI digested DNA from various species per lane. The probe was labelled by PCR amplification reactions as described in section 2 above, and hybridizations were done in 80% buffer B(2 g polyvinylpyrrolidine, 2 g Ficoll-400, 2 g bovine serum albumin, 50 ml 1M Tris-HCl (pH 7.5) 58 g NaCl, 1 g sodium pyrophosphate, 10 g sodium dodecyl sulfate, 950 ml H$_2$O) containing 10% dextran sulfate. The probes were denatured by boiling for ten minutes then rapidly cooling in ice water. The probe was added to the hybridization buffer at $10^6$ dpm $^{32}$P per ml and incubated overnight at 60° C. The filters were washed at 60° C. first in buffer B followed by 2×SSC, 0.1% SDS then in 1×SSC, 0.1% SDS. For high stringency, experiments, final washes were done in 0.1×SSC, 1% SDS and the, temperature raised to 650° C.

Southern blot data were used to prepare a restriction map of the genomic clone and to indicate which subfragments hybridized to the GGF probes (candidates for subcloning).

V. Subcloning of Segments of DNA Homologous to Hybridization Probes

DNA digests (e.g. 5 micrograms) were loaded onto 1% agarose gels then appropriate fragments excised from the gels following staining. The DNA was purified by adsorption onto glass beads followed by elution using the protocol described by the supplier (Bio 101). Recovered DNA fragments (100–200 ng) were ligated into linearized dephosphorylated vectors, e.g. pT3T7 (Ambion), which is a derivative of pUC18, using T4 ligase (New England Biolabs). This vector carries the E. coli β lactamase gene, hence, transformants can be selected on plates containing ampicillin. The vector also supplies β-galactosidase complementation to the host cell, therefore non-recombinants (blue) can be detected using isopropylthiogalactoside and Bluogal (Bethesda Research Labs). A portion of the ligation reactions was used to transform E. coli K12 XL1 blue competent cells (Stratagene Catalogue Number: 200236) and then the transformants were selected on LB plates containing 50 micrograms per ml ampicillin. White colonies were selected and plasmid mini preps were prepared for DNA digestion and for DNA sequence analysis. Selected clones were retested to determine if their insert DNA hybridized with the GGF probes.

VI. DNA Sequencing

Double stranded plasmid DNA templates were prepared from 5 ml cultures according to standard protocols. Sequencing was by the dideoxy chain termination method using Sequenase 2.0 and a dideoxynucleotide sequencing kit (US Biochemical) according to the manufacturers protocol (a modification of Sanger et al. PNAS; USA 74:5463 (1977)). Alternatively, sequencing was done in a DNA thermal cycler (Perkin Elmer, model 4800) using a cycle sequencing kit (New England Biolabs; Bethesda Research Laboratories) and was performed according to manufacturers instructions using a 5'-end labelled primer. Sequence primers were either those supplied with the sequencing kits or were synthesized according to sequence determined from the clones. Sequencing reactions were loaded on and resolved on 0.4 mm thick sequencing gels of 6% polyacrylamide. Gels were dried and exposed to X-Ray film. Typically, 35S was incorporated when standard sequencing kits were used and a 32P end labelled primer was used for cycle sequencing reactions. Sequences were read into a DNA sequence editor from the bottom of the gel to the top (5' direction to 3') and data were analyzed using programs supplied by Genetics Computer Group (GCG, University of Wisconsin).

VII. RNA Preparation and PCR Amplification

Open reading frames detected in the genomic DNA and which contained sequence encoding GGF peptides were extended via PCR amplification of pituitary RNA. RNA was prepared from frozen bovine tissue (Pelfreeze) according to the guanidine neutral-CsCl procedure (Chirgwin et. al. Biochemistry 18:5294(1979).) Polyadenylated RNA was selected by oligo-dT cellulose column chromatography (Aviv and Leder PNAS (USA) 69:1408 (1972)).

Specific DNA target sequences were amplified beginning with either total RNA or polyadenylated RNA samples that had been converted to cDNA using the Perkin Elmer PCR/RNA Kit Number: N808-0017. First strand reverse transcription reactions used 1 μg template RNA and either primers of oligo dT with restriction enzyme recognition site linkers attached or specific antisense primers determined from cloned sequences with restriction sites attached. To produce the second strand, the primers either were plus strand unique sequences as used in 3' RACE reactions (Frohman et. al., PNAS (USA) 85:8998 (1988)) or were oligo dT primers with restriction sites attached if the second target site had been added by terminal transferase tailing first strand reaction products with DATP (e.g. 5' race reactions, Frohman et. al., ibid). Alternatively, as in anchored PCR reactions the second strand primers were degenerate, hence, representing particular peptide sequences.

The amplification profiles followed the following general scheme: 1) five minutes soak file at 95° C.; 2) thermal cycle file of 1 minute, 95° C.; 1 minute ramped down to an annealing temperature of 45° C., 50° C. or 55° C.; maintain the annealing temperature for one minute; ramp up to 72° C. over one minute; extend at 72° C. for one minute or for one minute plus a 10 second auto extension; 3) extension cycle at 72° C., five minutes, and; 4) soak file 4° C. for infinite time. Thermal cycle files (#2) usually were run for 30 cycles. A sixteen μl sample of each 100 μl amplification reaction was analyzed by electrophoresis in 2% Nusieve 1% agarose gels run in TAE buffer at 4 volts per centimeter for three hours. The gels were stained, then blotted to uncharged nylon membranes which were probed with labelled DNA probes that were internal to the primers.

Specific sets of DNA amplification products could be identified in the blotting experiments and their positions used as a guide to purification and reamplification. When appropriate, the remaining portions of selected samples were loaded onto preparative gels, then following electrophoresis four to five slices of 0.5 mm thickness (bracketing the expected position of the specific product) were taken from the gel. The agarose was crushed, then soaked in 0.5 ml of electrophoresis buffer from 2–16 hours at 40° C. The crushed agarose was centrifuged for two minutes and the aqueous phase was transferred to fresh tubes.

Reamplification was done on five microliters (roughly 1% of the product) of the eluted material using the same sets of primers and the reaction profiles as in the original reactions. When the reamplification reactions were completed, samples were extracted with chloroform and transferred to fresh tubes. Concentrated restriction enzyme buffers and enzymes were added to the reactions in order to cleave at the restriction sites present in the linkers. The digested PCR products were purified by gel electrophoresis, then subcloned into vectors as described in the subcloning section above. DNA sequencing was done described as above.

VIII. DNA sequence Analysis

DNA sequences were assembled using a fragment assembly program and the amino acid sequences deduced by the GCG programs GelAssemble, Map and Translate. The deduced protein sequences were used as a query sequence to search protein sequence databases using WordSearch. Analysis was done on a VAX Station 3100 workstation operating under VMS 5.1. The database search was done on SwissProt release number 21 using GCG Version 7.0.

IX. Results of Cloning and Sequencing of Genes Encoding GGF-I and GGF-II

As indicated above, to identify the DNA sequence encoding bovine GGF-II degenerate oligonucleotide probes were designed from GGF-II peptide sequences. GGF-II 12 (SEQ ID NO: 52), a peptide generated via lysyl endopeptidase digestion of a purified GGF-II preparation (see FIGS. 16 and 12) showed strong amino acid sequence homology with GGF-I 07 (SEQ ID NO:24), a tryptic peptide generated from a purified GGF-I preparation. GGF-II 12 was thus used to create ten degenerate oligonucleotide probes (see oligos 609, 610 and 649 to 656 in FIG. 20, SEQ ID NOs: 69–76, 78, and 79, respectively). A duplicate set of filters were probed with two sets (set 1=609, 610; set 2=649–5656) of probes encoding two overlapping portions of GGF-II 12. Hybridization signals were observed, but, only one clone hybridized to both probe sets. The clone (designated GGF2BG1) was purified.

Southern blot analysis of DNA from the phage clone GGF2BG1 confirmed that both sets of probes hybridized with that bovine DNA sequence, and showed further that both probes reacted with the same set of DNA fragments within the clone. Based on those experiments a 4 kb Eco RI sub-fragment of the original clone was identified, subcloned and partially sequenced. FIG. 21 shows the nucleotide sequence, SEQ ID NO: 89 and the deduced amino acid sequence of the initial DNA sequence readings that included the hybridization sites of probes 609 and 650, and confirmed that a portion of this bovine genomic DNA encoded peptide 12 (KASLADSGEYM (SEQ ID NO: 129)).

Further sequence analysis demonstrated that GGF-II 12 resided on a 66 amino acid open reading frame (see below) which has become the starting point for the isolation of overlapping sequences representing a putative bovine GGF-II gene and a cDNA.

Several PCR procedures were used to obtain additional coding sequences for the putative bovine GGF-II gene. Total RNA and oligo dT-selected (poly A containing) RNA samples were prepared from bovine total pituitary, anterior pituitary, posterior pituitary, and hypothalamus. Using primers from the list shown in FIG. 22B, SEQ ID NOs: 109–119, one-sided PCR reactions (RACE) were used to amplify cDNA ends in both the 3' and 5' directions, and anchored PCR reactions were performed with degenerate oligonucleotide primers representing additional GGF-II peptides. FIG. 29 summarizes the contiguous DNA structures and sequences obtained in those experiments. From the 3' RACE reactions, three alternatively spliced cDNA sequences were produced, which have been cloned and sequenced. A 5' RACE reaction led to the discovery of an additional exon containing coding sequence for at least 52 amino acids. Analysis of that deduced amino acid sequence revealed peptides GGF-II-6 and a sequence similar to GGF-I-18 (see below). The anchored PCR reactions led to the identification of (cDNA) coding sequences of peptides GGF-II-1, 2, 3 and 10 contained within an additional cDNA segment of 300 bp. The 5' limit of this segment (i.e., segment E, see FIG. 30) is defined by the oligonucleotide which encodes peptide GGF-II-1 and which was used in the PCR reaction (additional 5'0 sequence data exists as described for the human clone in Example 11). Thus this clone contains nucleotide sequences encoding six out of the existing total of nine novel GGF-II peptide sequences.

The cloned gene was characterized first by constructing a physical map of GGF2BG1 that allowed us to position the coding sequences as they were found (see below, FIG. 30). DNA probes from the coding sequences described above have been used to identify further DNA fragments containing the exons on this phage clone and to identify clones that overlap in both directions. The putative bovine GGF-II gene is divided into at least 5 coding segments. Coding segments are defined as discrete lengths of DNA sequence which can be translated into polypeptide sequences using the universal genetic code. The coding segments described in FIG. 36 and referred to in the present application are: 1) particular exons present within the GGF gene (e.g. coding segment a), or 2) derived from sets of two or more exons that appear in specific sub-groups of mRNAs, where each set can be translated into the specific polypeptide segments as in the gene products shown. The polypeptide segments referred to in the claims are the translation products of the analogous DNA coding segments. Only coding segments A and B have been defined as exons and sequenced and mapped thus far. The summary of the contiguous coding sequences identified is shown in FIGS. 31A–B. The exons are listed (alphabetically) in the order of their discovery. It is apparent from the intron/exon boundaries that exon B may be included in cDNAs that connect coding segment E and coding segment A. That is, exon B cannot be spliced out without compromising the reading frame. Therefore, we suggest that three alternative splicing patterns can produce putative bovine GGF-II cDNA sequences 1, 2 and 3. The coding sequences of these, designated GGF2BPP1.CDS, GGF2BPP2.CDS and GGF2BPP3.CDS, respectively, are given in FIGS. 27A SEQ ID NO:133), 27(B–C), (SEQ ID NO:134) and 27(D–E), (SEQ ID NO:135), respectively. The deduced amino acid sequence of the three cDNAs is also given in FIGS. 27A–B (SEQ ID NO: 384), 27(B–C), (SEQ ID NO: 385), and 27(D–E), (SEQ ID NO: 387).

The three deduced structures encode proteins of lengths 206, 263, and 257 amino acids. The first 183 residues of the deduced protein sequence are identical in all three gene products. At position 184 the clones differ significantly. A codon for glycine GGT in GGF2BPP1 also serves as a splice donor for GGF2BPP2 and GGF2BPP3, which alternatively add on exons C, C/D, C/D' and D or C, C/D and D, respectively, and shown in FIGS. 32A–B, SEQ ID NO: 149. GGFIIBPP1 is a truncated gene product which is generated by reading past the coding segment A splice junction into the following intervening sequence (intron). This represents coding segment A' in FIG. 30E, SEQ ID NO: 140. The transcript ends adjacent to a canonical AATAAA (SEQ ID NO: 420) polyadenylation sequence, and we suggest that this truncated gene product represents a bona fide mature transcript. The other two longer gene products share the same 3' untranslated sequence and polyadenylation site.

All three of these molecules contain six of the nine novel GGF-II peptide sequences (see FIG. 11) and another peptide is highly homologous to GGF-I-18 (see FIG. 26). This finding gives a high probability that this recombinant molecule encodes at least a portion of bovine GGF-II. Furthermore, the calculated isoelectric points for the three peptides are consistent with the physical properties of GGF-I and II. Since the molecular size of GGF-II is roughly 60 kD, the longest of the three cDNAs should encode a protein with nearly one-half of the predicted number of amino acids.

A probe encompassing the B and A exons was labelled via PCR amplification and used to screen a cDNA library made from RNA isolated from bovine posterior pituitary. One clone (GGF2BPP5) showed the pattern indicated in FIG. 29 and contained an additional DNA coding segment (G) between coding segments A and C. The entire nucleic acid sequence is shown in FIGS. 31A–B, SEQ ID NO:148. The predicted translation product from the longest open reading frame is 241 amino acids. A portion of a second cDNA (GGF2BPP4) was also isolated from the bovine posterior pituitary library using the probe described above. This clone showed the pattern indicated in FIG. 29. This clone is incomplete at the 5' end, but is a splicing variant in the sense that it lacks coding segments G and D. BPP4 also displays a novel 3' end with regions H, K and L beyond region C/D. The sequence of BPP4 is shown in FIGS. 33A–C, SEQ ID NO: 150.

EXAMPLE 11

GGF Sequences in Various Species

Figure 28:
FIG. 28, which relates to Example 15 hereinafter, is an autoradiogram of a cross hybridization analysis of putative bovine GGF-II gene sequences to a variety of mammalian DNAs on a southern blot. The filter contains lanes of EcoRI-digested DNA (5 $\mu$g per lane) from the species listed in the Figure. The probe detects a single strong band in each DNA sample, including a four kilobase fragment in the bovine DNA as anticipated by the physical map in FIG. 24. Bands of relatively minor intensity are observed as well, which could represent related DNA sequences. The strong hybridizing band from each of the other mammalian DNA samples presumably represents the GGF-II homologue of those species.
Figure 35:
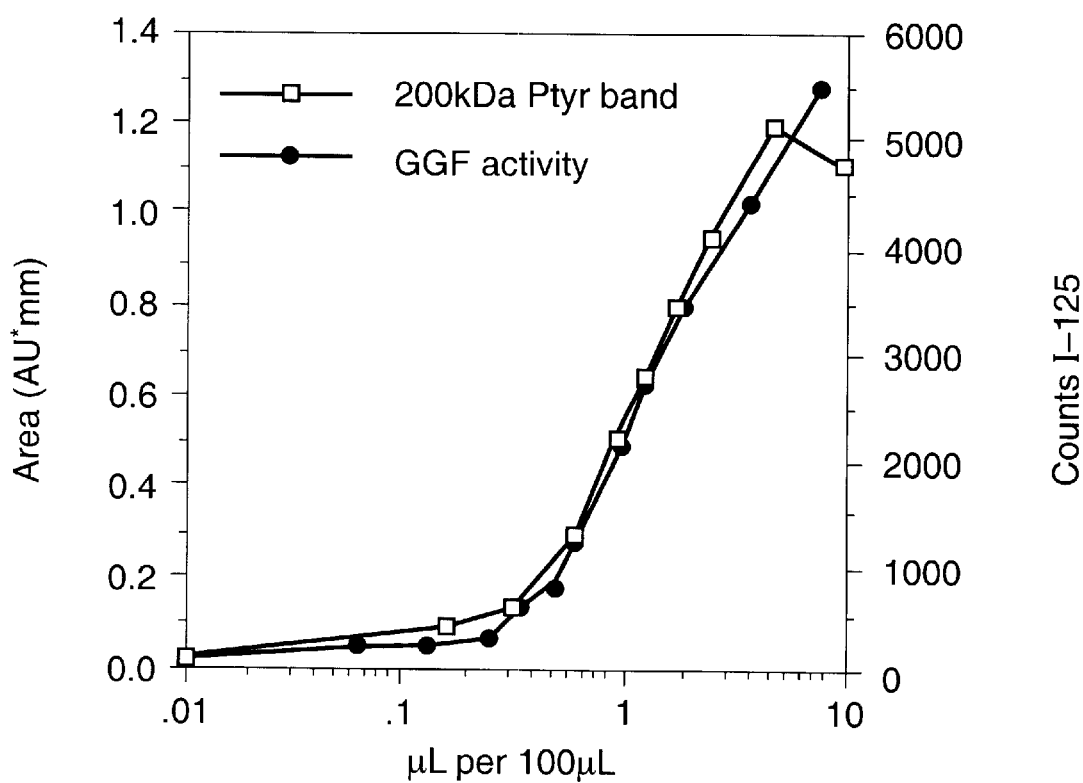
FIG. 35 depicts the level of GGF activity (Schwann cell mitogenic assay) and tyrosine phosphorylation of a ca. 200 kD protein (intensity of a 200 kD band on an autoradiogram of a Western blot developed with an antiphosphotyrosine polyclonal antibody) in response to increasing amounts of GGF.
Figure 43:
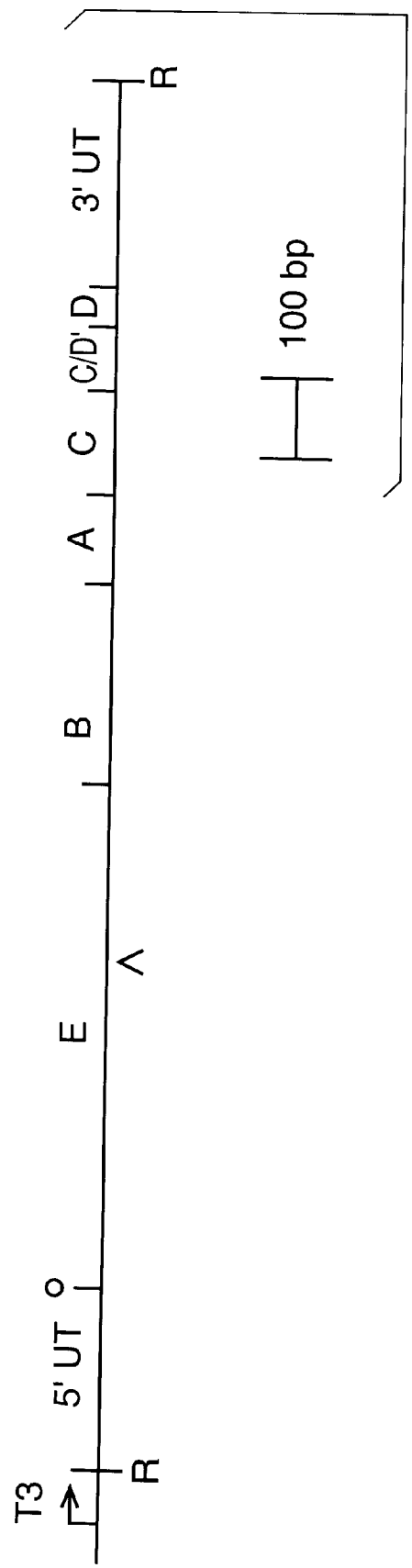
FIG. 43 is a scale coding segment map of the clone. T3 refers to the bacteriophage promoter used to produce mRNA from the clone. R=flanking EcoRI restriction enzyme sites. 5' UT refers to the 5' untranslated region. E, B, A, C, C/D', and D refer to the coding segments. O=the translation start site. Λ=the 5' limit of the region homologous to the bovine E segment (see Example 16) and 3' UT refers to the 3' untranslated region.

The GGF proteins are the members of a new superfamily of proteins. In high stringency cross hybridization studies (DNA blotting experiments) with other mammalian DNAs we have shown, clearly, that DNA probes from this bovine recombinant molecule can readily detect specific sequences in a variety of samples tested. A highly homologous sequence is also detected in human genomic DNA. The autoradiogram is shown in FIG. 28. The signals in the lanes containing rat and human DNA represent the rat and human equivalents of the GGF gene, the sequences of several cDNA's encoded by this gene have been recently reported by Holmes et al. (Science 256: 1205 (1992)) and Wen et al. (Cell 69: 559 (1992)).

EXAMPLE 12

Isolation of a Human Sequence Encoding Human GGF2

Several human clones containing sequences from the bovine GGFII coding segment E were isolated by screening a human cDNA library prepared from brain stem (Stratagene catalog #935206). This strategy was pursued based on the strong link between most of the GGF2 peptides (unique to GGF2) and the predicted peptide sequence from clones containing the bovine E segment. This library was screened as described in Example 8, Section II using the oligonucleotide probes 914–919 listed below.
914TCGGGCTCCATGAAGAAGATGTA (SEQ ID NO: 179)
915TCCATGAAGAAGATGTACCTGCT (SEQ ID NO: 180)
916ATGTACCTGCTGTCCTCCTTGA (SEQ ID NO: 181)
917TTGAAGAAGGACTCGCTGCTCA (SEQ ID NO: 182)
918AAAGCCGGGGGCTTGAAGAA (SEQ ID NO: 183)
919ATGARGTGTGGGCGGCGAAA (SEQ ID NO: 184)

Figure 47:
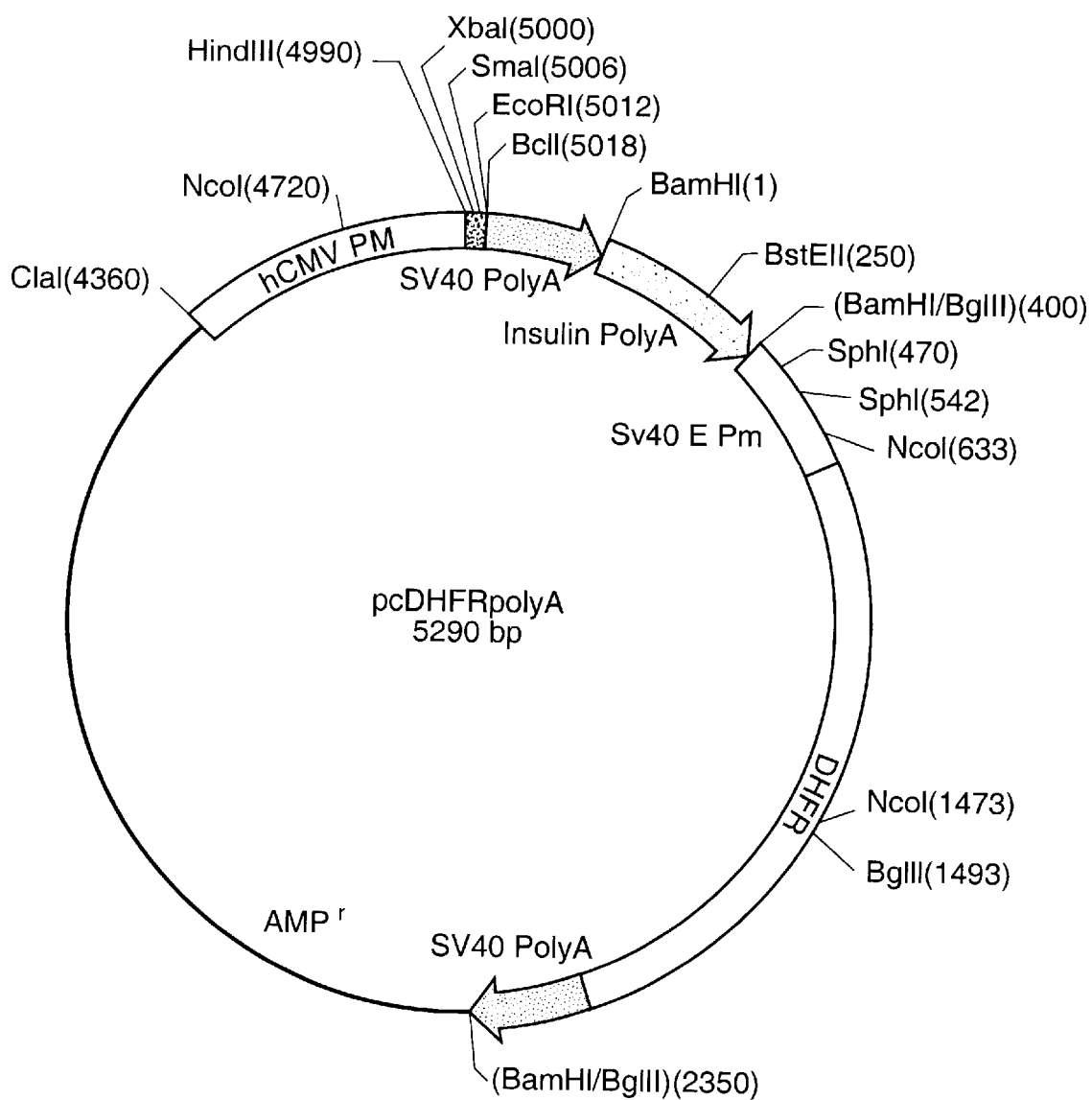
FIG. 47 is a map of the plasmid pcDHRFpolyA.

Clones detected with these probes were further analyzed by hybridization. A probe derived from coding segment A (see FIG. 30), which was produced by labeling a polymerase chain reaction (PCR) product from segment A, was also used to screen the primary library. Several clones that hybridized with both A and E derived probes were selected and one particular clone, GGF2HBS5, was selected for further analysis. This clone is represented by the pattern of coding segments (EBACC/D'D as shown in FIG. 30). The E segment in this clone is the human equivalent of the truncated bovine version of E shown in FIG. 30. GGF2HBS5 is the most likely candidate to encode GGF-II of all the "putative" GGF-II candidates described. The length of coding sequence segment E is 786 nucleotides plus 264 bases of untranslated sequence. The predicted size of the protein encoded by GGF2HBS5 is approximately 423 amino acids (approximately 45 kilodaltons, see FIG. 44, SEQ ID NO: 21 SEQ ID NO: 170), which is similar to the size of the deglycosylated form of GGF-II (see Example 19). Additionally, seven of the GGF-II peptides listed in FIG. 26 have equivalent sequences which fall within the protein sequence predicted from region E. Peptides II-6 and II-12 are exceptions, which fall in coding segment B and coding segment A, respectively. RNA encoding the GGF2HBS5 protein was produced in an in vitro transcription system driven by the bacteriophage T7 promoter resident in the vector (Bluescript SK [Stratagene Inc.] see FIG. 47) containing the GGF2HBS5 insert. This RNA was translated in a cell free (rabbit reticulocyte) translation system and the size of the protein product was 45 Kd. Additionally, the cell-free product has been assayed in a Schwann cell mitogenic assay to confirm biological activity. Schwann cells treated with conditioned medium show both increased proliferation as measured by incorporation of $^{125}$I-Uridine and phosphorylation on tyrosine of a protein in the 185 kilodalton range.

Thus the size of the product encoded by GGF2HBS5 and the presence of DNA sequences which encode human peptides highly homologous to the bovine peptides shown in FIG. 11 confirm that GGF2HBS5 encodes the human equivalent of bovine GGF2. The fact that conditioned media prepared from cells transformed with this clone elicits Schwann cell mitogenic activity confirms that the GGFII-HBS5 gene produce (unlike the BPP5 gene product) is secreted. Additionally the GGFIIBPP5 gene product seems to mediate the Schwann cell proliferation response via a receptor tyrosine kinase such as $p185^{erbB2}$ or a closely related receptor (see Example 18).

EXAMPLE 13

Expression of Human Recombinant GGF2 in Mammalian and Insect Cells

The GGF2HBS5 cDNA clone encoding human GGF2 (as described in Example 12 and also referred to herein as HBS5) was cloned into vector pcDL-SRα296 and COS-7 cells were transfected in 100 mm dishes by the DEAE-dextran method. Cell lysates or conditioned media from transiently expressing COS cells were harvested at 3 or 4 days post-transfection. To prepare lysates, cell monolayers were washed with PBS, scraped from the dishes lysed by three freeze/thaw cycles in 150 μm of 0.25 M Tris-HCl, pH8. Cell debris was pelleted and the supernatant recovered. Conditioned media samples (7 mls.) were collected, then concentrated and buffer exchanged with 10 mm Tris, pH 7.4 using Centiprep-10 and Centricon-10 units as described by the manlufactures (amicon, Beverly, Mass). Rat nerve Schwann cells were assayed for incorporation of DNA synthesis precursors, as described. Conditioned media or cell lysate samples were tested in the Schwann cell proliferation assay as described in Marchionni et al., Nature 362:313 (1993). The cDNA, GGF2HBS5, encoding GGF2 directed the secretion of the protein product to the medium. Minimal activity was detectable inside the cells as determined by assays using cell lysates. GGF2HFB1 and GGFBPP5 cDNA's failed to direct the secretion of the product to the extracellular medium. GGF activity from these clones was detectable only in cell lysates.

Recombinant GGF2 was also expressed in CHO cells. The GGF2HBS5 cDNA encoding GGF2 was cloned into the EcoRI site of vector pcdhfrpolyA and transfected into the DHFR negative CHO cell line (GG44) by the calcium phosphate coprecipitation method. Clones were selected in nucleotide and nucleoside free α medium (Gibco) in 96-well plates. After 3 weeks, conditioned media samples from individual clones were screened for expression of GGF by the Schwann cell proliferation assay as described in Marchionni et al., Nature 362:313 (1993). Stable clones which secreted significant levels of GGF activity into the medium were identified. Schwann cell proliferation activity data from different volume aliquots of CHO cell conditioned medium were used to produce the dose response curve shown in FIG. 46 (Graham and Van Der Eb, Virology 52:456, 1973). This material was analyzed on a Western blot probed with polyclonal antisera raised against a GGF2 specific peptide. A band of approximately 65 Kd (the expected size of GGF2 extracted from pituitary) is specifically labeled (FIG. 48, lane 12).

Recombinant GGF2 was also expressed in insect cells using the Baculovirus expression. Sf9 insect cells were infected with baculovirus containing the GGF2HBS5 cDNA clone at a multiplicity of 3–5 ($10^6$ cells/ml) and cultured in Sf900-II medium. Schwann cell mitogenic activity was secreted into the extracellular medium. Different volumes of insect cell conditioned medium were tested in the Schwann cell proliferation assay in the absence of forskolin and the data used to produce a dose response curve.

This material was also analyzed on a Western blot (FIG. 45B) probed with the GGF II specific antibody described above.

The methods used in this example were as follows:

Schwann cell mitogenic activity of recombinant human and bovine glial growth factors was determined as follows: Mitogenic responses of cultured Schwann cells were measured in the presence of 5 μM forskolin using crude recombinant GGF preparations obtained from transient mammalian expression experiments. Incorporation of [$^{125}$I]-Urd was determined following an 18–24 hour exposure to materials obtained from transfected or mock transfected cos cells as described in the Methods. The mean and standard deviation of four sets of data are shown. The mitogenic response to partially purified native bovine pituitary GGF (carboxymethyl cellulose fraction; Goodearl et al., submitted) is shown (GGF) as a standard of one hundred percent activity.

cDNAs (FIG. 46, SEQ ID NOs: 170–172) were cloned into pcDL-SRα296 (Takebe et al., Mol. Cell Biol. 8:466–472 (1988)), and COS-7 cells were transfected in 100 mm dishes by the DEAE-dextran method (Sambrook et al., In *Molecular Cloning. A Laboratory Manual, 2nd. ed.* (Cold Spring Harbor Laboratory Press, Cold Spring Harbor, N.Y., 1989)). Cell lysates or conditioned media were harvested at 3 or 4 days post-transfection. To prepare lysates, cell monolayers were washed with PBS, scraped from the dishes, and lysed by three freeze/than cycles in 150 μl of 0.25 M Tris-HCl, pH 8. Cell debris was pelleted and the supernate recovered. Conditioned media samples (7 mls) were collected, then concentrated and buffer exchanged with 10 mM Tris, pH 7.4 using Centriprep-10 and Centricon-10 units are described by the manufacturers (Amicon, Beverly, Mass.). Rat sciatic nerve Schwann cells were assayed for incorporation of DNA synthesis precursors, as described (Davis and Stroobant, J. Cell Biol. 110:1353–1360 (1990); Brockes et al., Brain Res. 165:105–118 (1979)).

Western blot of recombinant CHO cell conditioned medium were performed as follows: A recombinant CHO clone was cultured in MCDB302 protein-free for 3 days. 2 ml of conditioned medium was harvested, concentrated, buffered exchanged against 10 mM Tris-HCl, pH 7.4 and lyophilized to dryness. The pellet was resuspended in SDS-PAGE sample buffer, subjected to reducing SDS gel electrophoresis and analyzed by Western blotting with a GGF peptide antibody. A CHO control was done by using conditioned medium from untransfected CHO-DG44 host and the CHO HBS5 levels were assayed using conditioned medium from a recombinant clone.

EXAMPLE 14

Identification of Functional Elements of GGF

The deduced structures of the family of GGF sequences indicate that the longest forms (as represented by GGF2BPP4) encode transmembrane proteins where the extracellular part contains a domain which resembles epidermal growth factor (see Carpenter and Wahl in Peptide Growth Factors and Their Receptors I pp. 69–133, Springer-verlag, NY 1991). The positions of the cysteine residues in coding segments C and C/D or C/D' peptide sequence are conserved with respect to the analogous residues in the epidermal growth factor (EGF) peptide sequence (see FIG. 34, SEQ ID NOs: 151–153). This suggests that the extracellular domain functions as receptor recognition and biological activation sites. Several of the variant forms lack the H, K, and L coding segments and thus may be expressed as secreted, diffusible biologically active proteins. GGF DNA sequences encoding polypeptides which encompass the EGF-like domain (EGFL) can have full biological activity for stimulating glial cell mitogenic activity.

Membrane bound versions of this protein may induce Schwann cell proliferation if expressed on the surface of neurons during embryogenesis or during nerve regeneration (where the surfaces of neurons are intimately associated with the surfaces of proliferating Schwann cells).

Secreted (non membrane bound) GGFs may act as classically diffusible factors which can interact with Schwann cells at some distance from their point of secretion. Other forms may be released from intracells by sources via tissue injury and cell disruption. An example of a secreted GGF is the protein encoded by GGF2HBS5; this is the only GGF known which has been found to be directed to the exterior of the cell. Secretion is probably mediated via an N-terminal hydrophobic sequence found only in region E, which is the N-terminal domain contained within recombinant GGF2 encoded by GGF2HBS5.

Other GGF's appear to be non-secreted. These GGFs may be injury response forms which are released as a consequence of tissue damage.

Other regions of the predicted protein structure of GGF2 (encoded by GGF2HBS5) and other proteins containing regions B and A exhibit similarities to the human basement membrane heparan sulfate proteoglycan core protein. The peptide ADSGEY, which is located next to the second cysteine of the C2 immunoglobulin fold in these GGF's, occurs in nine of twenty-two C-2 repeats found in that basal lamina protein. This evidence strongly suggests that these proteins may associate with matrix proteins such as those associated with neurons and glia, and may suggest a method for sequestration of glial growth factors at target sites.

EXAMPLE 15

Purification of GGFs from Recombinant Cells

In order to obtain full length or portions of GGFs to assay for biological activity, the proteins can be overproduced using cloned DNA. Several approaches can be used. A recombinant *E. coli* cell containing the sequences described above can be constructed. Expression systems such as pNH8a or pHH16a (Stratagene, Inc.) can be used for this purpose by following manufacturers procedures. Alternatively, these sequences can be inserted in a mammalian expression vector and an overproducing cell line can be constructed. As an example, for this purpose DNA encoding a GGF, clone GGF2BPP5 has been expressed in COS cells and can be expressed in Chinese hamster ovary cells using the pMSXND expression vector (Lee and Nathans, J. Biol. Chem. 263, 3521–3527, (1981)). This vector containing GGF DNA sequences can be transfected into host cells using established procedures.

Transient expression can be examined or G418-resistant clones can be grown in the presence of methotrexate to select for cells that amplify the dhfr gene (contained on the pMSXND vector) and, in the process, co-amplify the adjacent GGF protein encoding sequence. Because CHO cells can be maintained in a totally protein-free medium (Hamilton and Ham, In Vitro 13, 537–547 (1977)), the desired protein can be purified from the medium. Western analysis using the antisera produced in Example 16 can be used to detect the presence of the desired protein in the conditioned medium of the overproducing cells.

Figure 45B:
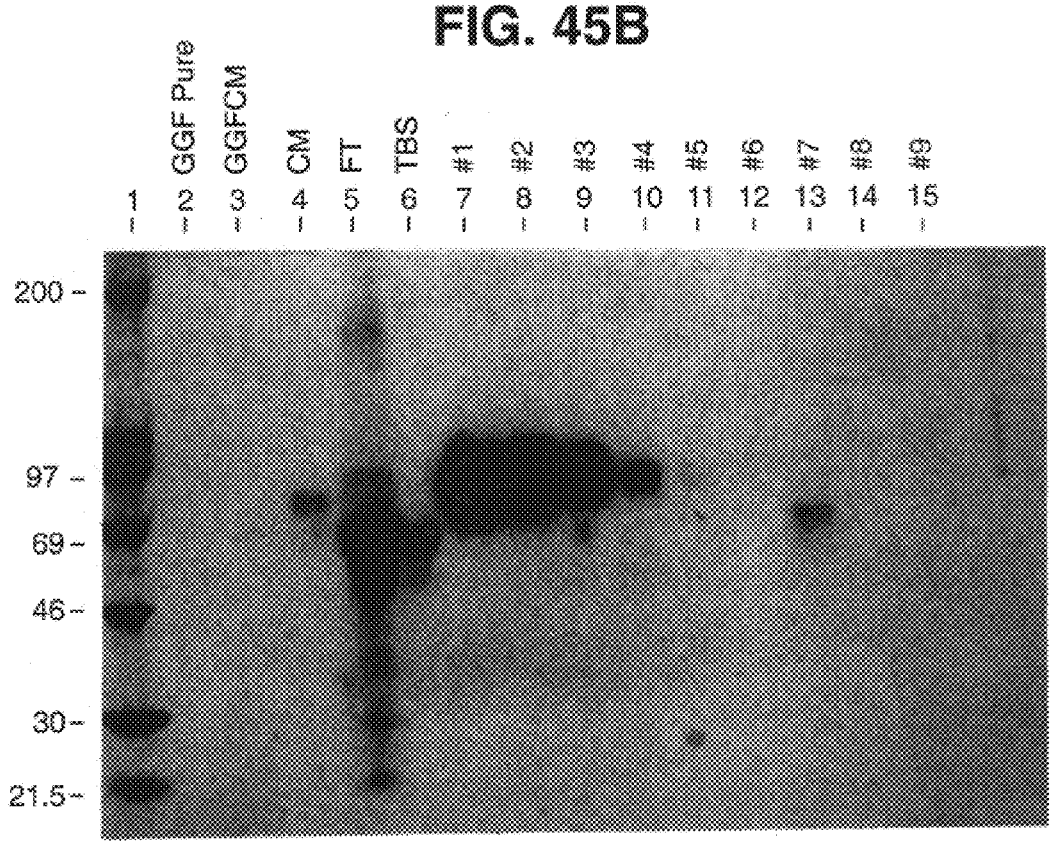
FIGS. 45B–C is a photograph of a Western blot using fractions as depicted in (A) and a GGFII specific antibody.
Figure 45C:
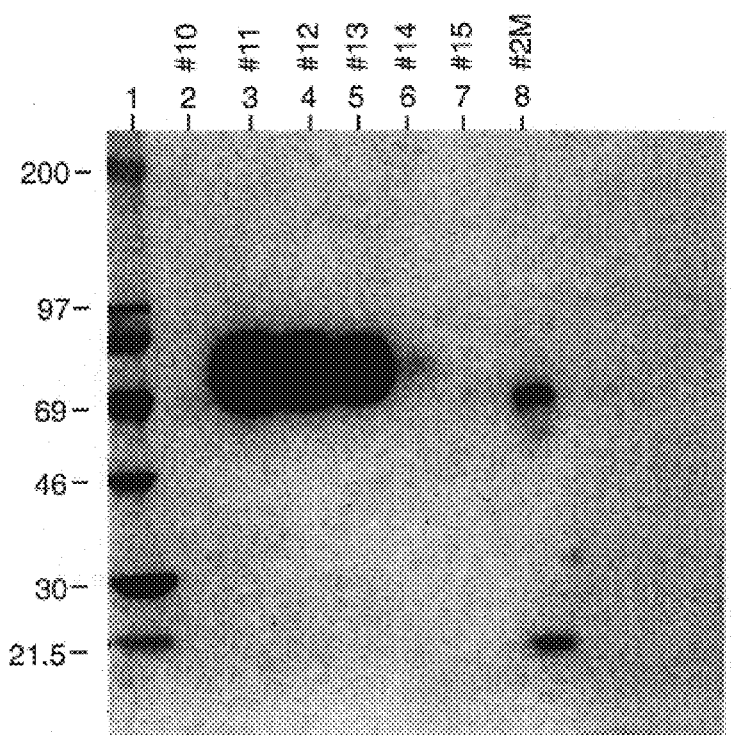

The desired protein (rGGF2) was purified from the medium conditioned by transiently expressing cos cells as follows. rGGF II was harvested from the conditioned medium and partially purified using Cation Exchange Chromatography (POROS-HS). The column was equilibrated with 33.3 mM MES pH 6.0. Conditioned media was loaded at flow rate of 10 ml/min. The peak containing Schwann cell proliferation activity and immunoreactive (using the polyclonal antisera was against a GGF2 peptide described above) was eluted with 50 mM Tris, 1M NaCl pH 8.0.

rhGGF2 is also expressed using a stable Chinese Ovary Hamster cell line. rGGF2 from the harvested conditioned media was partially purified using Cation Exchange Chromatograph (POROS-HS). The column was equilibrated with PBS pH 7.4. Conditioned media was loaded at 10 ml/min. The peak containing the Schwann Cell Proliferative activity and immunoreactivity (using GGF2 polyclonal antisera) was eluted with 50 mM Hepes, 500 mM NaCl pH 8.0. An additional peak was observed at 50 mM Hepes, 1M NaCl pH 8.0 with both proliferation as well as immunoreactivity (FIG. 45).

rhGGF2 can be further purified using Hydrophobic Interaction Chromatography as a high resolution step; Cation exchange/Reserve phase Chromatography (if needed as second high resolution step); A viral inactivation step and a DNA removal step such as Anion exchange chromatography.

Schwann Cell Proliferation Activity of recombinant GGF2 peak eluted from the Cation Exchange column was determined as follows: Mitogenic responses of the cultured Schwann cells were measured in the presence of 5 M Forskolin using the peak eluted by 50 mM Tris 1 M NaCl pH 8.0. The peak was added at 20 1, 10 1 (1:10) 10 1 and (1:100) 10 1. Incorporation of $^{125}$I-Uridine was determined and expressed as (CPM) following an 18–24 hour exposure.

An immunoblot using polyclonal antibody raised against a peptide of GGF2 was carried out as follows: 10 1 of different fractions were ran on 4–12% gradient gels. The gels were transferred on to Nitrocellulose paper, and the nitrocellulose blots were blocked with 5% BSA and probed with GGF2-specific antibody (1:250 dilution). $^{125}$I protein A (1:500 dilution, Specific Activity=9.0/Ci/g) was used as the secondary antibody. The immunoblots were exposed to Kodax X-Ray films for 6 hours. The peak fractions eluted with 1 M NaCl showed an immunoreactive band at 69K.

GGF2 purification on cation exchange columns was performed as follows: CHO cell conditioned media expressing rGGFII was loaded on the cation exchange column at 10 ml/min. The column was equilibrated with PBS pH 7.4. The elution was achieved with 50 mM Hepes 500 mM NaCl pH 8.0 and 50 mM Hepes 1M NaCl pH 8.0 respectively. All fractions were analyzed using the Schwann cell proliferation assay (CPM) described herein. The protein concentration (mg/ml) was determined by the Bradford assay using BSA as the standard.

A Western blot using 10 1. of each fraction was performed and immunoreactivity and the Schwann cell activity were observed to co-migrate.

The protein may be assayed at various points in the procedure using a Western blot assay. Alternatively, the Schwann cell mitogenic assay described herein may be used to assay the expressed product of the full length clone or any biologically active portions thereof. The full length clone GGF2BPP5 has been expressed transiently in COS cells. Intracellular extracts of transfected COS cells show biological activity when assayed in the Schwann cell proliferation assay described in Example 8. In addition, the full length close encoding GGF2HBS5 has been expressed transiently in COS cells. In this case both cell extract and conditioned media show biological activity in the Schwann cell proliferation assay described in Example 8. Any member of the family of splicing variant complementary DNA's derived from the GGF gene (including the Heregulins) can be expressed in this manner and assayed in the Schwann cell proliferation assay by one skilled in the art.

Alternatively, recombinant material may be isolated from other variants according to Wen et al. (Cell 69:559 (1992)) who expressed the splicing variant Neu differentiation factor (NDF) in COS-7 cells. cDNA clones inserted in the pJT-2 eukaryotic plasmid vector are under the control of the SV40 early promoter, and are 3'-flanked with the SV40 termination and polyadenylation signals. COS-7 cells were transfected with the pJT-2 plasmid DNA by electroporation as follows: 6×10$^6$ cells (in 0.8 ml of DMEM and 10% FEBS) were transferred to a 0.4 cm cuvette and mixed with 20 $\mu$g of plasmid DNA in 10 $\mu$l of TE solution (10 mM Tris-HCl (pH 8.0), 1 mM EDTA). Electroporation was performed at room temperature at 1600 V and 25 $\mu$F using a Bio-Rad Gene Pulser apparatus with the pulse controller unit set at 200 ohms. The cells were then diluted into 20 ml of DMEM, 10% FBS and transferred into a T75 flask (Falcon). After 14 hr. of incubation at 37° C., the medium was replaced with DMEM, 1% FBS, and the incubation continued for an additional 48 hr. Conditioned medium containing recombinant protein which was harvested from the cells demonstrated biological activity in a cell line expressing the receptor for this protein. This cell line (cultured human breast carcinoma cell line AU 565) was treated with recombinant material. The treated cells exhibited a morphology change which is characteristic of the activation of the erbB2 receptor. Conditioned medium of this type also can be tested in the Schwann cell proliferation assay.

EXAMPLE 16

Isolation of a Further Splicing Variant

Methods for updating other neuregulins described in U.S. patent application Ser. No. 07/965,173, filed Oct. 23, 1992, incorporated herein by reference, produced four closely related sequences (heregulin α, β1, β2, β3) which arise as a result of splicing variation. Peles et al. (Cell 69:205 (1992)), and Wen et al. (Cell 69:559 (1992)) have isolated another splicing variant (from rat) using a similar purification and cloning approach to that described in Examples 1–9 and 11 involving a protein which binds to p185$^{erbB2}$. The cDNA clone was obtained as follows (via the purification and sequencing of a p185$^{erbB2}$ binding protein from a transformed rat fibroblast cell line). A p185$^{erbB2}$ binding protein was purified from conditioned medium as follows. Pooled conditioned medium from three harvests of 500 roller bottles (120 liters total) was cleared by filtration through 0.2μ filters and concentrated 31-fold with a Pelicon ultrafiltration system using membranes with a 20 kd molecular size cutoff. All the purification steps were performed by using a Pharmacia fast protein liquid chromatography system. The concentrated material was directly loaded on a column of heparin-Sepharose (150 ml, preequilibrated with phosphate-buffered saline (PBS)). The column was washed with PBS containing 0.2 M NaCl until no absorbance at 280 nm wavelength could be detected. Bound proteins were then eluted with a continuous gradient (250 ml) of NaCl (from 0.2 M to 1.0 M), and 5 ml fractions were collected. Samples (0.01 ml of the collected fractions were used for the quantitative assay of the kinase stimulatory activity. Active fractions from three column runs (total volume=360 ml) were pooled, concentrated to 25 ml by using a YM10 ultrafiltration membrane (Amicon, Danvers, Mass.), and ammonium sulfate was added to reach a concentration of 1.7 M. After clearance by centrifugation (10,000×g, 15 min.), the pooled material was loaded on a phenyl-Superose column (HR10/10, Pharmacia). The column was developed with a 45 ml gradient of $(NH_4)_2SO_4$ (from 1.7 M to no salt) in 0.1 M $Na_2PO_4$ (pH 7.4), and 2 ml fractions were collected and assayed (0.002 ml per sample) for kinase stimulation (as described in Example 18). The major peak of activity was pooled and dialyzed against 50 mM sodium phosphate buffer (pH 7.3). A Mono-S cation-exchange column (HR5/5, Pharmacia) was preequilibrated with 50 mM sodium phosphate. After loading the active material (0.884 mg of protein; 35 ml), the column was washed with the starting buffer and then developed at a rate of 1 ml/min. with a gradient of NaCl. The kinase stimulatory activity was recovered at 0.45–0.55 M salt and was spread over four fractions of 2 ml each. These were pooled and loaded directly on a $Cu^{+2}$ chelating columns (1.6 ml, HR2/5 chelating Superose, Pharmacia). Most of the proteins adsorbed to the resin, but they gradually eluted with a 30 ml linear gradient of ammonium chloride (0–1 M). The activity eluted in a single peak of protein at the range of 0.05 to 0.2 M $NH_4Cl$. Samples from various steps of purification were analyzed by gel electrophoresis followed by silver staining using a kit from ICN (Costa Mesa, Calif.), and their protein contents were determined with a Coomassie blue dye binding assay using a kit from Bio-Rad (Richmond, Calif.).

The p44 protein (10 μg) was reconstituted in 200 μl of 0.1 M ammonium bicarbonate buffer (pH 7.8). Digestion was conducted with L-1-tosyl-amide 2-phenylethyl chloromethyl ketone-treated trypsin (Serva) at 37° C. for 18 hr. at an enzyme-to-substrate ratio of 1:10. The resulting peptide mixture was separated by reverse-phase HPLC and monitored at 215 nm using a Vydac C4 micro column (2.1 mm i.d.×15 cm, 300 Å) and an HP 1090 liquid chromatographic system equipped with a diode-array detector and a workstation. The column was equilibrated with 0.1% trifluoroacetic acid (mobile phase A), and elution was effected with a linear gradient from 0%–55% mobile phase B (90% acetonitrile in 0.1% trifluoroacetic acid) over 70 min. The flow rate was 0.2 ml/min. and the column temperature was controlled at 25° C. One-third aliquots of the peptide peaks collected manually from the HPLC system were characterized by N-terminal sequence analysis by Edman degradation. The fraction eluted after 27.7 min. (T27.7) contained mixed amino acid sequences and was further rechromatographed after reduction as follows: A 70% aliquot of the peptide fraction was dried in vacuo and reconstituted in 100 μl of 0.2 M ammonium bicarbonate buffer (pH 7.8). DTT (final concentration 2 mM) was added to the solution, which was then incubated at 37° C. for 30 min. The reduced peptide mixture was then separated by reverse-phase HPLC using a Vydac column (2.1 mm i.d.×15 cm). Elution conditions and flow rat were identical to those described above. Amino acid sequence analysis of the peptide was performed with a Model 477 protein sequencer (Applied Biosystems, Inc., Foster City, Calif.) equipped with an on-line phenylthiohydantoin (PTH) amino acid analyzer and a Model 900 data analysis system (Hunkapiller et al. (1986) In *Methods of Protein Microcharacterization*, J. E. Shively, ed. (Clifton, N.J.: Humana Press p. 223–247). The protein was loaded onto a trifluoroacetic acid-treated glass fiber disc precycled with polybrene and NaCl. The PTH-amino acid analysis was performed with a micro liquid chromatography system (Model 120) using dual syringe pumps and reverse-phase (C-18) narrow bore columns (Applied Biosystems, 2.1 mm×250 mm). RNA was isolated from Rat1-EJ cells by standard procedures (Maniatis et al., Molecular Cloning: A Laboratory Manual (Cold Spring Harbor, N.Y. (1982) and poly (A)$^+$ was selected using an mRNA Separator kit (Clontech Lab, Inc., Palo Alto, Calif.). cDNA was synthesized with the Superscript kit (from BRL Life Technologies, Inc., Bethesda, Md.). Column-fractionated double-strand cDNA was ligated into an Sal1- and Not1-digested pJT-2 plasmid vector, a derivative of the pCD-X vector (Okayama and Berg, Mol. Cell Biol. 3: 280 (1983)) and transformed into DH10B *E. coli* cells by electroporation (Dower et al., Nucl. Acids Res. 16: 6127 (1988)). Approximately $5 \times 10^5$ primary transformants were screened with two oligonucleotide probes that were derived from the protein sequences of the N-terminus of NDF (residues 5–24) and the T40.4 tryptic peptide (residues 7–12). Their respective sequences were as follows (N indicates all 4 nt):

(1) 5'-ATA GGG AAG GGC GGG GGA AGG GTC NCC CTC NGC A T AGG GCC GGG CTT GCC TCT GGA GCC TCT-3'
(2) 5'-TTT ACA CAT ATA TTC NCC-3' C G G C
(1: SEQ ID NO: 167; 2: SEQ ID NO: 168)

The synthetic oligonucleotides were end-labeled with [γ-$^{32}$P]ATP with T4 polynucleotide kinase and used to screen replicate sets of nitrocellulose filters. The hybridization solution contained 6×SSC, 50 mM sodium phosphate (pH 6.8), 0.1% sodium pyrophosphate, 2×Denhardt's solution, 50 μg/ml salmon sperm DNA, and 20% formamide (for probe 1) or no formamide (for probe 2). The filters were washed at either 50° C. with 0.5×SSC, 0.2% SDS, 2 mM EDTA (for probe 1) or at 37° C. with 2×SSC, 0.2% SDS, 2 mM EDTA (for probe 2). Autoradiography of the filters gave ten clones that hybridized with both probes. These clones were purified by replating and probe hybridization as described above. The cDNA clones were sequenced using an Applied Biosystems 373A automated DNA sequencer and Applied Biosystems Taq DyeDeoxy™ Terminator cycle sequencing kits following the manufacture's instructions. In some instances, sequences were obtained using [$^{35}$S]dATP (Amersham) and Sequenase™ kits from U.S. Biochemicals following the manufacturer's instructions. Both strands of the cDNA clone 44 were sequenced by using synthetic oligonucleotides as primers. The sequence of the most 5' 350 nt was determined in seven independent cDNA clones. The resultant clone demonstrated the pattern shown in FIG. 27 (NDF).

EXAMPLE 17

Purification and Assay of Other Proteins Which Bind p185$^{erbB2}$ Receptor

I. Purification of gp30 and p70

Lupu et al. (Science 249, 1552 (1990)) and Lippman and Lupu (patent application number PCT/US91/03443 (1990)), hereby incorporated by reference, have purified a protein from conditioned media of a human breast cancer cell line MDA-MB-231.

Lupu et al. (Proc. Natl. Acad. Sci. 89, 2287 (1992)) purified another protein which binds to the p185$^{erbB2}$ receptor. This particular protein, p75, was purified from conditioned medium used for the growth of SKBr-3 (a human breast cancer cell line) propagated in improved Eagle's medium (IMEM: GIBCO) supplemented with 10% fetal bovine serum (GIBCO).

II. Other p185$^{erbB2}$ Ligands

Peles et al. (Cell 69, 205 (1992)) have also purified a p185$^{erbB2}$ stimulating ligand from rat cells. Holmes et al. (Science 256, 1205 (1992)) have purified Heregulin α from human cells which binds and stimulates p185$^{erbB2}$ (see Example 5). Tarakovsky et al. Oncogene 6:218 (1991) have demonstrated binding of a 25 kD polypeptide isolated from activated macrophages to the Neu receptor, a p185$^{erbB2}$ homolog, herein incorporated by reference.

III. NDF Isolation

Yarden and Peles (Biochemistry 30, 3543 (1991)) have identified a 35 kilodalton glycoprotein which will stimulate the p185$^{erbB2}$ receptor.

In other publications, Davis et al. (Biochem. Biophys. Res. Commun. 179, 1536 (1991), Proc. Natl. Acad. Sci. 88, 8582 (1991) and Greene et al., PCT patent application PCT/US91/02331 (1990)) describe the purification of a protein from conditioned medium of a human T-cell (ATL-2) cell line.

Huang et al. (1992, J. Biol. Chem. 257:11508–11512), hereby incorporated by reference, have isolated an additional neu/erb B2 ligand growth factor from bovine kidney. The 25 kD polypeptide factor was isolated by a procedure of column fractionation, followed by sequential column chromatography on DEAE/cellulose (DE52), Sulfadex (sulfated Sephadex G-50), heparin-Sepharose 4B, and Superdex 75 (fast protein liquid chromatography). The factor, NEL-GF, stimulates tyrosine-specific autophosphorylation of the neu/ erb B2 gene product.

IV. Purification of Acetylcholine Receptor Inducing Activity (ARIA)

ARIA, a 42 kD protein which stimulates acetylcholine receptor synthesis, has been isolated in the laboratory of Gerald Fischbach (Falls et al., (1993) Cell 72:801–815). ARIA induces tyrosine phosphorylation of a 185 Kda muscle transmembrane protein which resembles p185$^{erbB2}$, and stimulates acetylcholine receptor synthesis in cultured embryonic myotubes. ARIA is most likely a member of the GGF/erbB2 ligand group of proteins, and this is potentially useful in the glial cell mitogenesis stimulation and other applications of, e.g., GGF2 described herein.

EXAMPLE 18

Protein Tyroine Phosphorylation Mediated by GGF

Rat Schwann cells, following treatment with sufficient levels of Glial Growth Factor to induce proliferation, show stimulation of protein tyrosine phosphorylation. Varying amounts of partially purified GGF were applied to a primary culture of rat Schwann cells according to the procedure outlined in Example 9. Schwann cells were grown in DMEM/10% fetal calf serum/5 μM forskolin/0.5 μg per mL GGF-CM (0.5 mL per well) in poly D-lysine coated 24 well plates. When confluent, the cells were fed with DMEM/10% fetal calf serum at 0.5 mL per well and left in the incubator overnight to quiesce. The following day, the cells were fed with 0.2 mL of DMEM/10% fetal calf serum and left in the incubator for 1 hour. Test samples were then added directly to the medium at different concentrations and for different lengths of time as required. The cells were then lysed in boiling lysis buffer (sodium phosphate, 5 mM, pH 6.8; SDS, 2%, β-mercapteothanol, 5%; dithiothreitol, 0.1M; glycerol, 10%; Bromophenol Blue, 0.4%; sodium vanadate, 10 mM), incubated in a boiling water bath for 10 minutes and then either analyzed directly or frozen at −70° C. Samples were analyzed by running on 7.5% SDS-PAGE gels and then electroblotting onto nitrocellulose using standard procedures as described by Towbin et al. (1979) Proc. Natl. Acad. Sci. USA 76:4350–4354. The blotted nitrocellulose was probed with antiphosphotyrosine antibodies using standard methods as described in Kamps and Selton (1988) Oncogene 2:305–315. The probed blots were exposed to autoradiography film overnight and developed using a standard laboratory processor. Densitometric measurements were carried out using an Ultrascan XL enhanced laser densitometer (LKB). Molecular weight assignments were made relative to prestained high molecular weight standards (Sigma). The dose responses of protein phosphorylation and Schwann cell proliferation are very similar (FIG. 33). The molecular weight of the phosphorylated band is very close to the molecular weight of p185$^{erbB2}$. Similar results were obtained when Schwann cells were treated with conditioned media prepared from cos cells translates with the GGF2HBS5 clone. These results correlate well with the expected binding and activation of p185$^{erbB2}$ by the GGFS.

This experiment has been repeated with recombinant GGF2. Conditioned medium derived from a CHO cell line stably transformed with the GGF2 clone (GGF2HBS5) stimulates protein tyrosine phosphorylation using the assay described above. Mock transfected CHO cells fail to stimulate this activity.

EXAMPLE 19

N-glycosylation of GGF

The protein sequence predicted from the cDNA sequence of GGF-II candidate clones GGF2BPP1, 2 and 3 contains a number of consensus N-glycosylation motifs. A gap in the GGFII02 peptide sequence coincides with the asparagine residue in one of these motifs, indicating that carbohydrate is probably bound at this site.

N-glycosylation of the GGFs was studied by observing mobility changes on SDS-PAGE after incubation with N-glycanase, an enzyme that cleaves the covalent linkages between carbohydrate and aspargine residues in proteins.

N-Glycanase treatment of GGF-II yielded a major band of MW 40–42 kDa and a minor band at 45–48 kDa. Activity single active deglycosylated species at ca 45–50 kDa.

Activity elution experiments with GGF-I also demonstrate an increase in electrophoretic mobility when treated with N-Glycanase, giving an active species of MW 26–28 kDa. Silver staining confirmed that there is a mobility shift, although no N-deglycosylated band could be assigned because of background staining in the sample used.

Further embodiments are within the following claims.

SEQUENCE LISTING (420 sequences)

SEQ ID NO: 1 - protein, 8 aa, Bos taurus
FKGDAHTE

SEQ ID NO: 2 - protein, 13 aa, Bos taurus
  VARIANT (1)...(12): Xaa in position 1 is Lysine or Arginine; Xaa in position 12 is unknown
XASLADEYEYMXK

SEQ ID NO: 3 - protein, 12 aa, Bos taurus
  VARIANT (1)...(10): Xaa in position 1 is Lysine or Arginine; Xaa in position 10 is unknown
XTETSSSGLXLK

SEQ ID NO: 4 - protein, 9 aa, Bos taurus
  VARIANT (1)...(1): Xaa in position 1 is Lysine or Arginine.
XKLGEMWAE

SEQ ID NO: 5 - protein, 7 aa, Bos taurus
  VARIANT (1)...(1): Xaa in position 1 is Lysine or Arginine
XLGEKRA

SEQ ID NO: 6 - protein, 16 aa, Bos taurus
  VARIANT (1)...(1): Xaa in position 1 is Lysine or Arginine
XIKSEHAGLSIGDTAK

SEQ ID NO: 7 - protein, 13 aa, Bos taurus
  VARIANT (1)...(1): Xaa in position 1 is Lysine or Arginine
XASLADEYEYMRK

SEQ ID NO: 8 - protein, 16 aa, Bos taurus
  VARIANT (1)...(1): Xaa in position 1 is Lysine or Arginine
XIKGEHPGLSIGDVAK

SEQ ID NO: 9 - protein, 13 aa, Bos taurus
  VARIANT (1)...(12): Xaa in position 1 is Lysine or Arginine and Xaa in position 12 is unknown
XMSEYAFFVQTXR

SEQ ID NO: 10 - protein, 14 aa, Bos taurus
  VARIANT (1)...(1): Xaa in position 1 is Lysine or Arginine
XSEHPGLSIGDTAK

SEQ ID NO: 11 - protein, 10 aa, Bos taurus
  VARIANT (1)...(8): Xaa in position 1 is Lysine or Arginine; Xaa in position 8 is unknown
XAGYFAEXAR

SEQ ID NO: 12 - protein, 9 aa, Bos taurus
  VARIANT (1)...(7): Xaa in position 1 is Lysine or Arginine; Xaa in position 7 is unknown
XKLEFLXAK

SEQ ID NO: 13 - protein, 11 aa, Bos taurus
  VARIANT (1)...(1): Xaa in position 1 is Lysine or Arginine
XTTEMASEQGA

SEQ ID NO: 14 - protein, 10 aa, Bos taurus
  VARIANT (1)...(1): Xaa in position 1 is Lysine or Arginine
XAKEALAALK

SEQ ID NO: 15 - protein, 8 aa, Bos taurus
  VARIANT (1)...(1): Xaa in position 1 is Lysine or Arginine
XFVLQAKK

SEQ ID NO: 16 - protein, 6 aa, Bos taurus
  VARIANT (1)...(1): Xaa in position 1 is Lysine or Arginine
XLGEMW

SEQ ID NO: 17 - protein, 16 aa, Bos taurus
EYKCLKFKWFKKATVM

SEQ ID NO: 18 - protein, 10 aa, Bos taurus
  VARIANT (8)...(8): Xaa in position 8 is unknown
EAKYFSKXDA

SEQ ID NO: 19 - protein, 7 aa, Bos taurus
  VARIANT (2)...(2): Xaa in position 2 is unknown
EXKFYVP

SEQ ID NO: 20 - protein, 26 aa, Bos taurus
ELSFASVRLPGCPPGVDPMVSFPVAL

SEQ ID NO: 21 - DNA, 2003 bp, Homo sapiens
  variation (31)...(32): N in positions 31 and 32 could be either A or G.
  CDS (265)...(1530)
ggaattcctttttttttttttttttttcttnntttttttttgcccttatacctcttcgcctttctgtggttccatccacttcttccccctcctcctcccataaacaactctcctacccctgcacccccaataaataaataaaaggaggagggcaaggggggaggaggaggagtggtgctgcgaggggaaggaaaagggaggcagcgcgagaagagccgggcagagtccgaaccgacagccagaagcccgcacgcacctcgcaccatgagatggcgacgcgccccgcgccgctccgggcgtcccggcccccgggcccagcgccccggctccgccgcccgctcgtcgccgccgctgccgctgctgccactactgctgctgctggggaccgcggccctggcgccgggggcggcggccggcaacgaggcggctcccgcgggggcctcggtgtgctactcgtccccgcccagcgtgggatcggtgcaggagctagctcagcgcgccgcggtggtcatcgagggaaaggtgcacccgcagcggcggcagcagggggcactcgacaggaaggcggcggcggcggcgggcgaggcaggggcgtggggcggcgatcgcgagccgccagccgcgggcccacgggcgctggggccgcccgccgaggagccgctgctcgccgccaacgggaccgtgccctcttggcccaccgccccggtgcccagcgccggcgagcccggggaggaggcgccctatctggtgaaggtgcaccaggtgtgggcggtgaaagccgggggcttgaagaaggactcgctgctcaccgtgcgcctggggacctggggccaccccgccttcccctcctgcgggaggctcaaggaggacagcaggtacatcttcttcatggagcccgacgccaacagcaccagccgcgcgccggccgccttccgagcctctttcccccctctggagacgggccggaacctcaagaaggaggtcagccgggtgctgtgcaagcggtgcgccttgcctccccaattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggaagtcagaacttcgcattaacaaagcatcactggctgattctggagagtatatgtgcaaagtgatcagcaaattaggaaatgacagtgcctctgccaatatcaccatcgtggaatcaaacgctacatctacatccaccactgggacaagccatcttgtaaaatgtgcggagaaggagaaaactttctgtgtgaatggaggggagtgcttcatggtgaaagacctttcaaacccctcgagatacttgtgcaagtgcccaaatgagtttactggtgatcgctgccaaaactacgtaatggccagcttctacagtacgtccactccctttctgtctctgcctgaataggagcatgctcagttggtgctgctttcttgttgctgcatctcccctcagattccacctagagctagatgtgtcttaccagatctaatattgactgcctctgcctgtcgcatgagaacattaacaaaagcaattgtattacttcctctgttcgcgactagttggctctgagatactaataggtgtgtgaggctccggatgtttctggaattgatattgaatgatgtgatacaaattgatagtcaatatcaagcagtgaaatatgataataaaggcatttcaaagtctcacttttattgataaaataaaaatcattctactgaacagtccatcttctttatacaatgaccacatcctgaaaagggtgttgctaagctgtaaccgatatgcacttgaaatgatggtaagttaattttgattcagaatgtgttatttgtcacaaataaacataataaaaggaaaaaaaaaaaaaa

SEQ ID NO: 22 - protein, 12 aa, Bos taurus
  VARIANT (11)...(11): Xaa in position 11 is unknown
ASLADEYEYMXK

SEQ ID NO: 23 - protein, 11 aa, Bos taurus
  VARIANT (9)...(9): Xaa in position 9 is unknown
TETSSSGLXLK

SEQ ID NO: 24 - protein, 12 aa, Bos taurus
ASLADEYEYMRK

SEQ ID NO: 25 - protein, 9 aa, Bos taurus
  VARIANT (7)...(7): Xaa in position 7 is unknown
AGYFAEXAR

SEQ ID NO: 26 - protein, 10 aa, Bos taurus
TTEMASEQGA

SEQ ID NO: 27 - protein, 9 aa, Bos taurus
AKEALAALK

SEQ ID NO: 28 - protein, 7 aa, Bos taurus
FVLQAKK

SEQ ID NO: 29 - protein, 21 aa, Bos taurus
ETQPDPGQILKKVPMVIGAYT

SEQ ID NO: 30 - protein, 21 aa, Homo sapiens
  VARIANT (1)...(19): Xaa in positions 1, 3, 17 and 19 is unknown
XEXKEGRGKGKGKKKEXGXGK

SEQ ID NO: 31 - protein, 13 aa, Homo sapiens
AEKEKTFCVNGGE

SEQ ID NO: 32 - protein, 8 aa, Bos taurus
  VARIANT (6)...(6): Xaa in position 6 is unknown
KLEFLXAK

SEQ ID NO: 33 - protein, 9 aa, Bos taurus
  VARIANT (1)...(1): Xaa in position 1 is Lysine or Arginine
XVHQVWAAK

SEQ ID NO: 34 - protein, 14 aa, Bos taurus
  VARIANT (1)...(11): Xaa in position 1 is Lysine or Arginine; Xaa in position 11 is unknown.
XYIFFMEPEAXSSG

SEQ ID NO: 35 - protein, 14 aa, Bos taurus
  VARIANT (1)...(13): Xaa in position 1 is Lysine or Arginine; Xaa in position 13 is unknown.
XLGAWGPPAFPVXY

SEQ ID NO: 36 - protein, 9 aa, Bos taurus
  VARIANT (1)...(1): Xaa in position 1 is Lysine or Arginine.
XWFVVIEGK

SEQ ID NO: 37 - protein, 16 aa, Bos taurus
  VARIANT (1)...(1): Xaa in position 1 is Lysine or Arginine
XASPVSVGSVQELVQR

SEQ ID NO: 38 - protein, 13 aa, Bos taurus
  VARIANT (1)...(1): Xaa in position 1 is Lysine or Arginine
XVCLLTVAALPPT

SEQ ID NO: 39 - protein, 7 aa, Bos taurus
  VARIANT (1)...(6): Xaa in position 1 is Lysine or Arginine; Xaa in position 6 is unknown
XDLLLXV

SEQ ID NO: 40 - DNA, 23 bp, Bos taurus
cagaaggtcttctccttctcagc

SEQ ID NO: 41 - DNA, 24 bp, Bos taurus
cctcgctccttcttcttgcccttc

SEQ ID NO: 42 - protein, 4 aa, Bos taurus
LVLR

SEQ ID NO: 43 - DNA, 36 bp, Bos taurus
agtacgtccactccctttctgtctctgcctgaatag

SEQ ID NO: 44 - DNA, 569 bp, Homo sapiens
  CDS (1)...(569)
aaggcggaggagctgtaccagaagagagtgctgaccataaccggcatctgcatcgccctccttgtggtcggcatcatgtgtgtggtggcctactgcaaaaccaagaaacagcggaaaaagctgcatgaccgtcttcggcagagccttcggtctgaacgaaacaatatgatgaacattgccaatgggcctcaccatcctaacccaccccccgagaatgtccagctggtgaatcaatacgtatctaaaaacgtcatctccagtgagcatattgttgagagagaagcagagacatccttttccaccagtcactatacttccacagcccatcactccactactgtcacccagactcctagccacagctggagcaacggacacactgaaagcatcctttccgaaagccactctgtaatcgtgatgtcatccgtagaaaacagtaggcacagcagcccaactgggggcccaagaggacgtcttaatggcacaggaggccctcgtgaatgtaacagcttcctcaggcatgccagagaaacccctgattcctaccgagactctcctcatagtgaaag

SEQ ID NO: 45 - protein, 8 aa, Bos taurus
VHQVWAAK

SEQ ID NO: 46 - protein, 13 aa, Bos taurus
  VARIANT (10)...(10): Xaa in position 10 is unknown
YIFFMEPEAXSSG

SEQ ID NO: 47 - protein, 13 aa, Bos taurus
  VARIANT (12)...(12): Xaa in position 12 is unknown
LGAWGPPAFPVXY

SEQ ID NO: 48 - protein, 8 aa, Bos taurus
WFVVIEGK

SEQ ID NO: 49 - protein, 15 aa, Bos taurus
ASPVSVGSVQELVQR

SEQ ID NO: 50 - protein, 12 aa, Bos taurus
VCLLTVAALPPT

SEQ ID NO: 51 - protein, 9 aa, Bos taurus
KVHQVWAAK

SEQ ID NO: 52 - protein, 13 aa, Bos taurus
  VARIANT (12)...(12): Xaa in position 12 is unknown
KASLADSGEYMXK

SEQ ID NO: 53 - protein, 6 aa, Bos taurus
  VARIANT (5)...(5): Xaa in position 5 is unknown
DLLLXV

SEQ ID NO: 54 - DNA, 20 bp, Bos taurus
  variation (1)...(18): N at positions 3, 12 and 18 is C  or T; N at position 6 is A or G; N at positions 9 and 15 is A, T,  G or C.
ttnaanggngangcncanac

SEQ ID NO: 55 - DNA, 21 bp, Bos taurus
  variation (1)...(21): N at positions 7 and 13 is C or T; N at positions 4, 10, and 16 is A or G; N at position 19 is A, T, G or C.
catntantcntantcntcngc

SEQ ID NO: 56 - DNA, 20 bp, Bos taurus
  variation (3)...(18): N at positions 3 and 15 is C or T;  N at positions 6, 9, and 18 is A, T, G or C
tgntcngangccatntcngt

SEQ ID NO: 57 - DNA, 20 bp, Bos taurus
  variation (3)...(17): N at positions 3 and 15 is C or T; N at position 6 is A or G; N at positions 9 and 18 is A, T, G or C.
tgntcnctngccatntcngt

SEQ ID NO: 58 - DNA, 20 bp, Bos taurus
  variation (3)...(18): N at position 3 is A, G or T; N at position 18 is C or T; N at positions 6, 12, and 15 is A, T, G or C.
ccnatnaccatnggnacntt

SEQ ID NO: 59 - DNA, 20 bp, Bos taurus
  variation (3)...(18): N at position 12 is C or T; N at position 15 is A or G; N at positions 3, 9 and 18 is A, T, G or C.
gcngcccanacytgrtgnac

SEQ ID NO: 60 - DNA, 20 bp, Bos taurus
  variation (1)...(20): N at positions 3 and 9 is C or T; N at positions 15 and 18 is A or G; N at position 6 is A, T, G or C.
gcntcnggntccatnaanaa

SEQ ID NO: 61 - DNA, 20 bp, Bos taurus
  variation (1)...(20): N at position 6 is A, G or T;  N at position 3 is C or T; N at position 15 is A or G; N at positions 9 and 12 is A, T, G or C.
ccntcnatnacnacnaacca

SEQ ID NO: 62 - DNA, 17 bp, Bos taurus
  variation (1)...(17): N at positions 6 and 9 is A or G; N at positions 3, 12 and 15 is A, T, G or C.
tcngcnaantanccngc

SEQ ID NO: 63 - DNA, 20 bp, Bos taurus
  variation (1)...(20): N at positions 12 and 15 is C or T;  N at positions 3, 6, 9 and 18 is A, T, G or C
gcngcnagngcntcnttngc

SEQ ID NO: 64 - DNA, 20 bp, Bos taurus
  variation (1)...(20): N at positions 6, 12 and 15 is C or T; N at positions 3, 9, and 18 is A, T, G or C.
gcngcnaangcntcnttngc

SEQ ID NO: 65 - DNA, 20 bp, Bos taurus
  variation (1)...(20): N at positions 3 and 9 is C or T; N at position 18 is A or G; N at positions 6, 12 and 15 is A, T, G or C.
ttnttngcntgnagnacnaa

SEQ ID NO: 66 - DNA, 20 bp, Bos taurus
  variation (1)...(20): N at positions 3, 9 and 12 is C or T; N at position 18 is A or G; N at positions 6 and 15 is A, T, G or C.
ttnttngcntgnaanacnaa

SEQ ID NO: 67 - DNA, 17 bp, Bos taurus
  variation (1)...(17): N at positions 9 and 12 is C or T; N at positions 3, 6 and 15 is A, T, G or C.
tgnacnagntcntgnac

SEQ ID NO: 68 - DNA, 17 bp, Bos taurus
  variation (1)...(17): N at positions 6, 9, and 12 is C or T; N at positions 3 and 15 is A, T, G or C.
tgnacnaantcntgnac

SEQ ID NO: 69 - DNA, 21 bp, Bos taurus
  variation (1)...(21): N at position 7 is C or T; N at positions 4 and 16 is A or G; N at positions 10, 13 and 19 is A, T, G or C.
catntantcnccngantcngc

SEQ ID NO: 70 - DNA, 21 bp, Bos taurus
  variation (1)...(21): N at position 7 is C or T; N at positions 4, 13 and 16 is A or G; N at positions 10 and 19 is A, T, G or C.
catntantcnccnctntcngc

SEQ ID NO: 71 - DNA, 21 bp, Bos taurus
  variation (1)...(21): N at positions 10 and 19 is C or T; N at position 4 is A or G; N at positions 1, 7, 13 and 16 is A, T, G or C.
ngantcngcnaangangcntt

SEQ ID NO: 72 - DNA, 21 bp, Bos taurus
  variation (1)...(21): N at position 19 is C or T; N at position 4 is A or G; N at positions 1, 7, 10, 13 and 16 is A, T, G or C.
ngantcngcnagngangcntt

SEQ ID NO: 73 - DNA, 21 bp, Bos taurus
  variation (1)...(21): N at positions 10 and 19 is C or T; N at positions 1 and 4 is A or G; N at positions 7, 13 and 16 is A, T, G or C.
nctntcngcnaangangcntt

SEQ ID NO: 74 - DNA, 21 bp, Bos taurus
  variation (1)...(21): N at position 19 is C or T; N at positions 1 and 4 is A or G; N at positions 7, 10, 13 and 16 is A, T, G or C.
nctntcngcnagngangcntt

SEQ ID NO: 75 - DNA, 21 bp, Bos taurus
  variation (1)...(21): N at positions 10 and 19 is C or T; N at positions 4 and 13 is A or G; N at positions 1, 7 and 16 is A, T, G or C.
ngantcngcnaanctngcntt

SEQ ID NO: 76 - DNA, 21 bp, Bos taurus
  variation (1)...(21): N at position 19 is C or T; N at positions 4 and 13 is A or G; N at positions 1, 7, 10 and 16 is A, T, G or C.
ngantcngcnagnctngcntt

SEQ ID NO: 77 - DNA, 730 bp, Homo sapiens
gtatgtgtcagccatgaccaccccggctcgtatgtcacctgtagatttccacacgccaagctcccccaaatcgcccccttcggaaatgtctccacccgtgtccagcatgacggtgtccatgccttccatggcggtcagccccttcatggaagaagagagacctctacttctcgtgacaccaccaaggctgcgggagaagaagtttgaccatcaccctcagcagttcagctccttccaccacaaccccgcgcatgacagtaacagcctccctgctagccccttgaggatagtggaggatgaggagtatgaaacgacccaagagtacgagccagcccaagagcctgttaagaaactcgccaatagccggcgggccaaaagaaccaagcccaatggccacattgctaacagattggaagtggacagcaacacaagctcccagagcagtaactcagagagtgaaacagaagatgaaagagtaggtgaagatacgcctttcctgggcatacagaaccccctggcagccagtcttgaggcaacacctgccttccgcctggctgacagcaggactaacccagcaggccgcttctcgacacaggaagaaatccaggccaggctgtctagtgtaattgctaaccaagaccctattgctgtataaaacctaaataaacacatagattcacctgtaaaactttattttatataataaagtattccaccttaaattaaacaa

SEQ ID NO: 78 - DNA, 21 bp, Bos taurus
  variation (1)...(21): N at positions 10 and 19 is C or T; N at positions 1, 4 and 13 is A or G; N at positions 7 and 16 is A, T, G or C.
nctntcngcnaanctngcntt

SEQ ID NO: 79 - DNA, 21 bp, Bos taurus
  variation (1)...(21): N at position 19 is C or T; N at positions 1, 4 and 13 is A or G; N at positions 7, 10 and 16 is A, T, G or C.
nctnctngcnagnctngcntt

SEQ ID NO: 80 - DNA, 20 bp, Bos taurus
  variation (1)...(20): N at position 9 is A or G; N at positions 3, 6, 17 and 18 is A, T, G or C.
acnacnganatggctcnnga

SEQ ID NO: 81 - DNA, 20 bp, Bos taurus
  variation (1)...(20): N at position 16 is C or T; N at position 9 is A or G; N at positions 3, 6, 17 and 18 is A, T, G or C.
acnacnganatggcagnnga

SEQ ID NO: 82 - DNA, 20 bp, Bos taurus
  variation (1)...(20): N at position 3 is C or T; N at position 6 is A or G; N at positions 9, 15 and 18 is A, T, G or C.
cancangtntgggcngcnaa

SEQ ID NO: 83 - DNA, 20 bp, Bos taurus
  variation (1)...(20): N at position 3 is C or T; N at position 15 is A or G; N at positions 5, 9 and 18 is A, T, G or C; N at position 12 is A, C or T.
ttngtngtnatnganggnaa

SEQ ID NO: 84 - DNA, 20 bp, Bos taurus
  variation (1)...(20): N at positions 9 and 15 is C or T; N at position 3 is A or G; N at positions 6, 12 and 18 is A, T, G or C.
aanggngangcncanacnga

SEQ ID NO: 85 - DNA, 20 bp, Bos taurus
  variation (1)...(20): N at positions 7 and 16 is C or T; N at position 3 is A or G; N at positions 6, 9, 12, 15 and 18 is A, T, G or C.
gangcnntngcngcnntnaa

SEQ ID NO: 86 - DNA, 20 bp, Bos taurus
  variation (1)...(20): N at position 19 is C or T; N at positions 15 and 18 is A or G; N at positions 3, 6, 9 and 12 is A, T, G or C.
gtnggntcngtncangannt

SEQ ID NO: 87 - DNA, 20 bp, Bos taurus
  variation (1)...(20): N at positions 9 and 19 is C or T; N at positions 15 and 18 is A or G; N at positions 3, 6 and 12 is A, T, G or C.
gtnggnagngtncangannt

SEQ ID NO: 88 - DNA, 21 bp, Bos taurus
  variation (1)...(21): N at positions 4, 7 and 16 is C or T; N at position 12 is A or G; N at positions 1, 10 and 19 is A, T, G or C; N at position 13 is A, C or T.
nacnttnttnannatntgncc

SEQ ID NO: 89 - DNA, 417 bp, Bos taurus
tctaaaactacagagactgtattttcatgatcatcatagttctgtgaaatatacttaaaccgctttggtcctgatcttgtaggaagtcagaacttcgcattagcaaagcgtcactggctgattctggagaatatatgtgcaaagtgatcagcaaactaggaaatgacagtgcctctgccaacatcaccattgtggagtcaaacggtaagagatgcctactgcgtgctatttctcagtctctaagaggagtgatcaaggtatgtggtcacacttgaatcacgcaggtgtctgaaatctcattgtgaacaaataaaaatcatgaaaggaaaactctatgtttgaaatatcttatgggtcctcctgtaaagctcttcactccataaggtgaaatagacctgaaatatatatagattattt

SEQ ID NO: 90 - DNA, 33 bp, Bos taurus
  variation (1)...(33): N in position 16 can be A or G; N in position 22 can be A or G; N in position 28 can be C or T.
ccgaattctgcagganacucanccuganccugg

SEQ ID NO: 91 - DNA, 37 bp, Bos taurus
  variation (1)...(37): N in position 17 can be A or G; N in position 26 can be A, C or T.
aaggatcctgcagugtntaugcuccnatuaccatugg

SEQ ID NO: 92 - DNA, 34 bp, Bos taurus
  variation (1)...(34): N in position 19 can be C or T; N in position 28 can be A or G; N in position 31 can be C or T.
ccgaattctgcaggcugantcuggugantanatg

SEQ ID NO: 93 - DNA, 33 bp, Bos taurus
  variation (1)...(33): N in position 19 can be C or T; N in position 22 can be C or T; N in position 28 can be A or G; N in position 31 can be C or T.
ccgaattctgcaggcuganagnggugantanat

SEQ ID NO: 94 - DNA, 34 bp, Bos taurus
  variation (1)...(34): N in position 20 can be A or G; N in position 23 can be C or T; N in position 32 can be A or G.
aaggatcctgcaguuucatntantcuccugantc

SEQ ID NO: 95 - DNA, 34 bp, Bos taurus
  variation (1)...(34): N in position 20 can be A or G; N in position 23 can be C or T; N in position 29 and 30 can be A or G; N in position 32 can be A or G.
aaggatcctgcaguuucatntantcuccnntntc

SEQ ID NO: 96 - DNA, 33 bp, Bos taurus
  variation (1)...(33): N in position 16 can be C or T; N in position 19 can be A or G.
ccgaattctgcagcancangtutgggcugctaa

SEQ ID NO: 97 - DNA, 35 bp, Bos taurus
  variation (1)...(35): N in position 16 can be A or G; N in position 19 can be C or T; N in position 22 can be C or T; N in position 28 can be A or G; N in position 34 can be A or G.
ccgaattctgcagatnttnttnatgganccugang

SEQ ID NO: 98 - DNA, 35 bp, Bos taurus
  variation (30)...(30): N in position 30 can be C or T.
ccgaattctgcaggggguccuccugcuttnccugt

SEQ ID NO: 99 - DNA, 33 bp, Bos taurus
  variation (1)...(33): N in position 19 can be C or T; N in position 28 can be A or C or T; N in position 31 can be A or G.
ccgaattctgcagtggttngtugtuatngangg

SEQ ID NO: 100 - DNA, 34 bp, Bos taurus
  variation (1)...(34): N at position 17, 20, and 26 is Inosinc. Y at positions 14 and 29 can be cytidine or thymidine.
aaggatcctgcagyttngcngcccanacytgrtg

SEQ ID NO: 101 - DNA, 33 bp, Bos taurus
  variation (1)...(33): N in position 16 can be C or T; N in position 22 can be C or T; N in position 28 can be A or G; N in position 31 can be A or G.
aaggatcctgcaggcntcuggntccatnaanaa

SEQ ID NO: 102 - DNA, 33 bp, Bos taurus
  variation (1)...(33): N in position 19 can be A or G.
aaggatcctgcagacuggnaaugcugguggucc

SEQ ID NO: 103 - DNA, 35 bp, Bos taurus
  variation (1)...(35): N in position 14 can be C or T; N in position 20 can be C or T; N in position 23 can be A or G or T; N in position 32 can be A or G.
aaggatcctgcagnttuccntcnatuacuacnaac

SEQ ID NO: 104 - DNA, 33 bp, Bos taurus
  variation (1)...(33): N in position 4 can be A or G; N in position 7 can be C or T; N in position 10 can be A or G; N in position 13 can be C or T.
catntantcntantctcugcaaggatcctgcag

SEQ ID NO: 105 - DNA, 33 bp, Bos taurus
  variation (1)...(33): N in position 16 can be A or G; N in position 22 can be C or T; N in position 28 can be C or T.
ccgaattctgcagaanggugangcucanacuga

SEQ ID NO: 106 - DNA, 33 bp, Bos taurus
  variation (1)...(33): N in position 6 can be C or T; N in position 12 can be C or T; N in position 15 can be C or T.
gcugcnaaugcntcnttugcaaggatcctgcag

SEQ ID NO: 107 - DNA, 33 bp, Bos taurus
  variation (1)...(33): N in position 12 can be C or T; N in position 15 can be C or T.
gcugcuagugcntcntttgcaaggatcctgcag

SEQ ID NO: 108 - DNA, 30 bp, Bos taurus
  variation (1)...(30): N in position 6 can be A or G; N in position 9 can be A or G.
tcugcnaantauccugcaaggatcctgcag

SEQ ID NO: 109 - DNA, 38 bp, Bos taurus
catcgatctgcaggctgattctggagaatatatgtgca

SEQ ID NO: 110 - DNA, 37 bp, Bos taurus
aaggatcctgcagccacatctcgagtcgacatcgatt

SEQ ID NO: 111 - DNA, 37 bp, Bos taurus
ccgaattctgcagtgatcagcaaactaggaaatgaca

SEQ ID NO: 112 - DNA, 37 bp, Bos taurus
catcgatctgcagcctagtttgctgatcactttgcac

SEQ ID NO: 113 - DNA, 37 bp, Bos taurus
aaggatcctgcagtatattctccagaatcagccagtg

SEQ ID NO: 114 - DNA, 34 bp, Bos taurus
aaggatcctgcaggcacgcagtaggcatctctta

SEQ ID NO: 115 - DNA, 35 bp, Bos taurus
ccgaattctgcagcagaacttcgcattagcaaagc

SEQ ID NO: 116 - DNA, 33 bp, Bos taurus
catcccgggatgaagagtcaggagtctgtggca

SEQ ID NO: 117 - DNA, 39 bp, Bos taurus
atacccgggctgcagacaatgagatttcacacacctgcg

SEQ ID NO: 118 - DNA, 36 bp, Bos taurus
aaggatcctgcagtttggaacctgccacagactcct

SEQ ID NO: 119 - DNA, 39 bp, Bos taurus
atacccgggctgcagatgagatttcacacacctgcgtga

SEQ ID NO: 120 - protein, 12 aa, Bos taurus
HQVWAAKAAGLK

SEQ ID NO: 121 - protein, 16 aa, Bos taurus
GGLKKDSLLTVRLGAW

SEQ ID NO: 122 - protein, 13 aa, Bos taurus
  VARIANT (1)...(12): Xaa in position 12 is unknown
LGAWGPPAFPVXY

SEQ ID NO: 123 - protein, 23 aa, Bos taurus
LLTVRLGAWGHPAFPSCGRLKED

SEQ ID NO: 124 - protein, 13 aa, Bos taurus
  VARIANT (10)...(10): Xaa in position 10 is unknown.
YIFFMEPEAXSSG

SEQ ID NO: 125 - protein, 23 aa, Bos taurus
KEDSRYIFFMEPEANSSGGPGRL

SEQ ID NO: 126 - protein, 14 aa, Bos taurus
VAGSKLVLRCETSS

SEQ ID NO: 127 - protein, 16 aa, Bos taurus
EYKCLKFKWFKKATVM

SEQ ID NO: 128 - protein, 26 aa, Bos taurus
CETSSEYSSLKFKWFKNGSELSRKNK

SEQ ID NO: 129 - protein, 11 aa, Bos taurus
KASLADSGEYM

SEQ ID NO: 130 - protein, 23 aa, Bos taurus
ELRISKASLADSGEYMCKVISKL

SEQ ID NO: 131 - protein, 12 aa, Bos taurus
ASLADEYEYMRK

SEQ ID NO: 132 - protein, 22 aa, Bos taurus
LRISKASLADSGEYMCKVISKL

SEQ ID NO: 133 - DNA, 744 bp, Bos taurus
  CDS (8)...(625)
cctgcagcatcaagtgtgggcggcgaaagccgggggcttgaagaaggactcgctgctcaccgtgcgcctgggcgcctggggccaccccgccttcccctcctgcgggcgcctcaaggaggacagcaggtacatcttcttcatggagcccgaggccaacagcagcggcgggcccggccgccttccgagcctccttcccccctctcgagacgggccggaacctcaagaaggaggtcagccgggtgctgtgcaacggtgcgccttgcctccccgcttgaaagagatgaagagtcaggagtctgtggcaggttccaaactagtgcttcggtgcgagaccagttctgaatactcctctctcaagttcaagtggttcaagaatgggagtgaattaagccgaaagaacaaaccagaaaacatcaagatacagaaaaggccggggaagtcagaacttcgcattagcaaagcgtcactggctgattctggagaatatatgtgcaaagtgatcagcaaactaggaaatgacagtgcctctgccaacatcaccattgtggagtcaaacggtaagagatgcctactgcgtgctatttctcagtctctaagaggagtgatcaaggtatgtggtcacacttgaatcacgcaggtgtgtgaaatctcattgtcaacaaataaaaatcatgaaaggaaaaaaaaaaaaaaaaaatcgatgtcgactcgagatgtggctgcaggtcgactctagaggatccc

SEQ ID NO: 134 - DNA, 1193 bp, Bos taurus
cctgcagcatcaagtgtgggcggcgaaagccgggggcttgaagaaggactcgctgctcaccgtgcgcctgggcgcctggggccaccccgccttcccctcctgcgggcgcctcaaggaggacagcaggtacatcttcttcatggagcccgaggccaacagcagcggcgggcccggccgccttccgagcctccttcccccctctcgagacgggccggaacctcaagaaggaggtcagccgggtgctgtgcaacggtgcgccttgcctccccgcttgaaagagatgaagagtcaggagtctgtggcaggttccaaactagtgcttcggtgcgagaccagttctgaatactcctctctcaagttcaagtggttcaagaatgggagtgaattaagccgaaagaacaaaccagaaaacatcaagatacagaaaaggccggggaagtcaggacttcgcattagcaaagcgtcactggctgattctggagaatatatgtgcaaagtgatcagcaaactaggaaatgacagtgcctctgccaacatcaccattgtggagtcaaacgccacatccacatctacagctgggacaagccatcttgtcaagtgtgcagagaaggagaaaactttctgtgtgaatggaggcgagtgcttcatggtgaaagacctttcaaatccctcaagatacttgtgcaagtgccaacctggattcactggagcgagatgtactgagaatgtgcccatgaaagtccaaacccaagaaagtgcccaaatgagtttactggtgatcgctgccaaaactacgtaatggccagcttctacagtacgtccactccctttctgtctctgcctgaatagcgcatctcagtcggtgccgctttcttgttgccgcatctcccctcagattcctcctagagctagatgcgttttaccaggtctaacattgactgcctctgcctgtcgcatgagaacattaacacaagcgattgtatgacttcctctgtccgtgactagtgggctctgagctactcgtaggtgcgtaaggctccagtgtttctgaaattgatcttgaattactgtgatacgacatgatagtccctctcacccagtgcaatgacaataaaggccttgaaaagtcaaaaaaaaaaaaaaaaaaaaaaatcgatgtcgactcgagatgtggctgcaggtcgactctagag

SEQ ID NO: 135 - DNA, 1108 bp, Bos taurus
  CDS (8)...(778)
cctgcagcatcaagtgtgggcggcgaaagccgggggcttgaagaaggactcgctgctcaccgtgcgcctgggcgcctggggccaccccgccttcccctcctgcgggcgcctcaaggaggacagcaggtacatcttcttcatggagcccgaggccaacagcagcggcgggcccggccgccttccgagcctccttcccccctctcgagacgggccggaacctcaagaaggaggtcagccgggtgctgtgcaacggtgcgccttgcctccccgcttgaaagagatgaagagtcaggagtctgtggcaggttccaaactagtgcttcggtgcgagaccagttctgaatactcctctctcaagttcaagtggttcaagaatgggagtgaattaagccgaaagaacaaaccagaaaacatcaagatacagaaaaggccggggaagtcagaacttcgcattagcaaagcgtcactggctgattctggagaatatatgtgcaaagtgatcagcaaactaggaaatgacagtgcctctgccaacatcaccattgtggagtcaaacgccacatccacatctacagctgggacaagccatcttgtcaagtgtgcagagaaggagaaaactttctgtgtgaatggaggcgagtgcttcatggtgaaagacctttcaaatccctcaagatacttgtgcaagtgcccaaatgagtttactggtgatcgctgccaaaactacgtaatggccagcttctacagtacgtccactccctttctgtctctgcctgaatagcgcatctcagtcggtgccgctttcttgttgccgcatctcccctcagattccgcctagagctagatgcgttttaccaggtctaacattgactgcctctgcctgtcgcatgagaacattaacacaagcgattgtatgacttcctctgtccgtgactagtgggctctgagctactcgtaggtgcgtaaggctccagtgtttctgaaattgatcttgaattactgtgatacgacatgatagtccctctcacccagtgcaatgacaataaaggccttgaaaagtcaaaaaaaaaaaaaaaaaaaaaatcgatgtcgactcgagatgtggctg

SEQ ID NO: 136 - DNA, 559 bp, Bos taurus
  variation (214)...(214): N in position 214 is unknown
agtttccccccccaacttgtcggaactctgggctcgcgcgcagggcaggagcggagcggcggcggctgcccaggcgatgcgagcgcgggccggacggtaatcgcctctccctcctcgggctgcgagcgcgccggaccgaggcagcgacaggagcggaccgcggcgggaaccgaggactccccagcggcgcgccagcaggagccaccccgcgagncgtgcgaccgggacggagcgcccgccagtcccaggtggcccggaccgcacgttgcgtccccgcgctccccgccggcgacaggagacgctcccccccacgccgcgcgcgcctcggcccggtcgctggcccgcctccactccggggacaaacttttcccgaagccgatcccagccctcggacccaaacttgtcgcgcgtcgccttcgccgggagccgtccgcgcagagcgtgcacttctcgggcgagatgtcggagcgcagagaaggcaaaggcaaggggaagggcggcaagaaggaccgaggctccgggaagaagcccgtgcccgcggctggcggcccgagcccag

SEQ ID NO: 137 - DNA, 252 bp, Bos taurus
  CDS (3)...(251)
  variation (8)...(8): N in position 8 could be either A or G.
  variation (2)...(2): Xaa is unknown.
cccatcangtgtgggcggcgaaagccgggggcttgaagaaggactcgctgctcaccgtgcgcctgggcgcctggggccaccccgccttcccctcctgcgggcgcctcaaggaggacagcaggtacatcttcttcatggagcccgaggccaacagcagcggcgggcccggccgccttccgagcctccttcccccctctcgagacgggccggaacctcaagaaggaggtcagccgggtgctgtgcaacggtgcg

SEQ ID NO: 138 - DNA, 178 bp, Bos taurus
ccttgcctccccgcttgaaagagatgaagagtcaggagtctgtggcaggttccaaactagtgcttcggtgcgagaccagttctgaatactcctctctcaagttcaagtggttcaagaatgggagtgaattaagccgaaagaacaaaccacaaaacatcaagatacagaaaaggccggg

SEQ ID NO: 139 - DNA, 122 bp, Bos taurus
  CDS (2)...(121)
gaagtcagaacttcgcattagcaaagcgtcactggctgattctggagaatatatgtgcaaagtgatcagcaaactaggaaatgacagtgcctctgccaacatcaccattgtggagtcaaacg

SEQ ID NO: 140 - DNA, 417 bp, Bos taurus
  CDS (84)...(272)
tctaaaactacagagactgtattttcatgatcatcatagttctgtgaaatatacttaaaccgctttggtcctgatcttgtaggaagtcagaacttcgcattagcaaagcgtcactggctgattctggagaatatatgtgcaaagtgatcagcaaactaggaaatgacagtgcctctgccaacatcaccattgtggagtcaaacggtaagagatgcctactgcgtgctatttctcagtctctaagaggagtgatcaaggtatgtggtcacacttgaatcacgcaggtgtgtgaaatctcattgtgaacaaataaaaatcatgaaaggaaaactctatgtttgaaatatcttatgggtcctcctgtaaagctcttcactccataaggtgaaatagacctgaaatatatatagattattt

SEQ ID NO: 141 - DNA, 102 bp, Bos taurus
  CDS (3)...(101)
agatcaccactggcatgccagcctcaactgagacagcgtatgtgtcttcagagtctcccattagaatatcagtatcaacagaaggaacaaatacttcttcat

SEQ ID NO: 142 - DNA, 69 bp, Bos taurus
  CDS (1)...(69)
aagtgccaacctggattcactggagcgagatgtactgagaatgtgcccatgaaagtccaaacccaagaa

SEQ ID NO: 143 - DNA, 60 bp, Bos taurus and Homo sapiens
  CDS (1)...(60)
aagtgcccaaatgagtttactggtgatcgctgccaaaactacgtaatggccagcttctac

SEQ ID NO: 144 - DNA, 36 bp, Bos taurus and Homo sapiens; identical to SEQ ID NO: 43

SEQ ID NO: 145 - DNA, 27 bp, Homo sapiens
  CDS (1)...(27)
aagcatcttgggattgaatttatggag

SEQ ID NO: 146 - DNA, 569 bp, Bos taurus
  CDS (1)...(565)
aaagcggaggagctctaccagaagagagtgctcaccattaccggcatttgcatcgcgctgctcgtggttggcatcatgtgtgtggtggtctactgcaaaaccaagaaacaacggaaaaagcttcatgaccggcttcggcagagccttcggtctgaaagaaacaccatgatgaacgtagccaacgggccccaccaccccaatccgccccccgagaacgtgcagctggtgaatcaatacgtatctaaaaatgtcatctctagcgagcatattgttgagagagaggcggagagctctttttccaccagtcactacacttcgacagctcatcattccactactgtcactcagactcccagtcacagctggagcaatggacacactgaaagcatcatttcggaaagccactctgtcatcgtgatgtcatccgtagaaaacagtaggcacagcagcccgactgggggcccgagaggacgtctcaatggcttgggaggccctcgtgaatgtaacagcttcctcaggcatgccagagaaacccctgactcctaccgagactctcctcatagtgaaag

SEQ ID NO: 147 - DNA, 730 bp, Bos taurus
  CDS (2)...(652)
gtatgtatcagcaatgaccaccccggctcgtatgtcacctgtagatttccacacgccaagctcccccaagtcacccccttcggaaatgtccccgcccgtgtccagcacgacggtctccatgccctccatggcggtcagtcccttcgtggaagaggagagacccctgctccttgtgacgccaccacggctgcgggagaagtatgaccaccacgcccagcaattcaactcgttccactgcaaccccgcgcatgagagcaacagcctgccccccagccccttgaggatagtggaggatgaggaatatgaaacgacccaggagtacgaaccagctcaagagccggttaagaaactcaccaacagcagccggcgggccaaaagaaccaagcccaatggtcacattgcccacaggttggaaatggacaacaacacaggcgctgacagcagtaactcagagagcgaaacagaggatgaaagagtaggagaagatacgcctttcctggccatacagaaccccctggcagccagtctcgaggcggcccctgccttccgcctggtcgacagcaggactaacccaacaggcggcttctctccgcaggaagaattgcaggccaggctctccggtgtaatcgctaaccaagaccctatcgctgtctaaaaccgaaatacacccatagattcacctgtaaaactttattttatataataaagtattccaccttaaattaaacaa

SEQ ID NO: 148 - DNA, 1652 bp, Bos taurus
  CDS (459)...(1181)
agtttccccccccaacttgtcggaactctgggctcgcgcgcagggcaggagcggagcggcggcggctgcccaggcgatgcgagcgcgggccggacggtaatcgcctctccctcctcgggctgcgagcgcgccggaccgaggcagcgacaggagcggaccgcggcgggaaccgaggactccccagcggcgcgccagcaggagccaccccgcgagcgtgcgaccgggacggagcgcccgccagtcccaggtggcccggaccgcacgttgcgtccccgcgctccccgccggcgacaggagacgctcccccccacgccgcgcgcgcctcggcccggtcgctggcccgcctccactccggggacaaacttttcccgaagccgatcccagccctcggacccaaacttgtcgcgcgtcgccttcgccgggagccgtccgcgcagagcgtgcacttctcgggcgagatgtcggagcgcagagaaggcaaaggcaaggggaagggcggcaagaaggaccgaggctccgggaagaagcccgtgcccgcggctggcggcccgagcccagccttgcctccccgcttgaaagagatgaagatgcaggagtctgtggcaggttccaaactagtgcttcggtgcgagaccagttctgaatactcctctctcaagttcaagtggttcaagaatgggagtgaattaagccgaaagaacaaaccacaaaacatcaagatacagaaaaggccggggaagtcagaacttcgcattagcaaagcgtcactggctgattctggagaatatatgtgcaaagtgatcagcaaactaggaaatgacagtgcctctgccaacatcaccattgtggagtcaaacgagatcaccactggcatgccagcctcaactgagacagcgtatgtgtcttcagagtctcccattagaatatcagtatcaacagaaggaacaaatacttcttcatccacatccacatctacagctgggacaagccatcttgtcaagtgtgcagagaaggagaaaactttctgtgtgaatggaggcgagtgcttcatggtgaaagacctttcaaatccctcaagatacttgtgcaagtgcccaaatgagtttactggtgatcgctgccaaaactacgtaatggccagcttctacagtacgtccactccctttctgtctctgcctgaataggcgcatgctcagtcggtgccgctttcttgttgccgcatctcccctcagattcaacctagagctagatgcgttttaccaggtctaacattgactgcctctgcctgtcgcatgagaacattaacacaagcgattgtatgacttcctctgtccgtgactagtgggctctgagctactcgtaggtgcgtaaggctccagtgtttctgaaattgatcttgaattactgtgatacgacatgatagtccctctcacccagtgcaatgacaataaaggccttgaaaagtctcacttttattgagaaaataaaaatcgttccacgggacagtccctcttctttataaaatgaccctatccttgaaaaggaggtgtgttaagttgtaaccagtacacacttgaaatgatggtaagttcgcttcggttcagaatgtgttctttctgacaaataaacagaataaaaaaaaaaaaaaaaaa

SEQ ID NO: 149 - DNA, 1140 bp, Bos taurus
  CDS (1)...(840): N is unknown.; Xaa is unknown.
catcangtgtgggcggcgaaagccgggggcttgaagaaggactcgctgctcaccgtgcgcctgggcgcctggggccaccccgccttcccctcctgcgggcgcctcaaggaggacagcaggtacatcttcttcatggagcccgaggccaacagcagcggcgggcccggccgccttccgagcctccttcccccctctcgagacgggccggaacctcaagaaggaggtcagccgggtgctgtgcaacggtgcgccttgcctccccgcttgaaagagatgaagagtcaggagtctgtggcaggttccaaactagtgcttcggtgcgagaccagttctgaatactcctctctcaagttcaagtggttcaagaatgggagtgaattaagccgaaagaacaaaccagaaaacatcaagatacagaaaaggccggggaagtcagaacttcgcattagcaaagcgtcactggctgattctggagaatatatgtgcaaagtgatcagcaaactaggaaatgacagtgcctctgccaacatcaccattgtggagtcaaacgccacatccacatctacagctgggacaagccatcttgtcaagtgtgcagagaaggagaaaactttctgtgtgaatggaggcgagtgcttcatggtgaaagacctttcaaatccctcaagatacttgtgcaagtgccaacctggattcactggagcgagatgtactgagaatgtgcccatgaaagtccaaacccaagaaaagtgcccaaatgagtttactggtgatcgctgccaaaactacgtaatggccagcttctacagtacgtccactccctttctgtctctgcctgaatagcgcatctcagtcggtgccgctttcttgttgccgcatctcccctcagattccncctagagctagatgcgttttaccaggtctaacattgactgcctctgcctgtcgcatgagaacattaacacaagcgattgtatgacttcctctgtccgtgactagtgggctctgagctactcgtaggtgcgtaaggctccagtgtttctgaaattgatcttgaattactgtgatacgacatgatagtccctctcacccagtgcaatgacaataaaggccttgaaaagtcaaaaaaaaaaaaaaaaa

SEQ ID NO: 150 - DNA, 1764 bp, Bos taurus
  CDS (2)...(1681)
gaagtcagaacttcgcattagcaaagcgtcactggctgattctggagaatatatgtgcaaagtgatcagcaaactaggaaatgacagtgcctctgccaacatcaccattgtggagtcaaacgccacatccacatctacagctgggacaagccatcttgtcaagtgtgcagagaaggagaaaactttctgtgtgaatggaggcgactgcttcatggtgaaagacctttcaaatccctcaagatacttgtgcaagtgccaacctggattcactggagcgagatgtactgagaatgtgcccatgaaagtccaaacccaagaaaaagcggaggagctctaccagaagagagtgctcaccattaccggcatttgcatcgcgctgctcgtggttggcatcatgtgtgtggtggtctactgcaaaaccaagaaacaacggaaaaagcttcatgaccggcttcggcagagccttcggtctgaaagaaacaccatgatgaacgtagccaacgggccccaccaccccaatccgccccccgagaacgtgcagctggtgaatcaatacgtatctaaaaatgtcatctctagcgagcatattgttgagagagaggcggagagctctttttccaccagtcactacacttcgacagctcatcattccactactgtcactcagactcccagtcacagctggagcaatggacacactgaaagcatcatttcggaaagccactctgtcatcgtgatgtcatccgtagaaaacagtaggcacagcagcccgactgggggcccgagaggacgtctcaatggcttgggaggccctcgtgaatgtaacagcttcctcaggcatgccagagaaacccctgactcctaccgagactctcctcatagtgaaagacataaccttatagctgagctaaggagaaacaaggcccacagatccaaatgcatgcagatccagctttccgcaactcatcttagagcttcttccattccccattgggcttcattctctaagaccccttggcctttaggaaggtatgtatcagcaatgaccaccccggctcgtatgtcacctgtagatttccacacgccaagctcccccaagtcacccccttcggaaatgtccccgcccgtgtccagcacgacggtctccatgccctccatggcggtcagtcccttcgtggaagaggagagacccctgctccttgtgacgccaccacggctgcgggagaagtatgaccaccacgcccagcaattcaactcgttccactgcaaccccgcgcatgagagcaacagcctgccccccagccccttgaggatagtggaggatgaggaatatgaaacgacccaggagtacgaaccagctcaagagccggttaagaaactcaccaacagcagccggcgggccaaaagaaccaagcccaatggtcacattgcccacaggttggaaatggacaacaacacaggcgctgacagcagtaactcagagagcgaaacagaggatgaaagagtaggagaagatacgcctttcctggccatacagaaccccctggcagccagtctcgaggcggcccctgccttccgcctggtcgacagcaggactaacccaacaggcggcttctctccgcaggaagaattgcaggccaggctctccggtgtaatcgctaaccaagaccctatcgctgtctaaaaccgaaatacacccatagattcacctgtaaaactttattttatataataaagtattccaccttaaattaaacaaaaaaa

SEQ ID NO: 151 - protein, 50 aa, Bos taurus
KCAEKEKTFCVNGGECFMVKDLSNPSRYLCKCPNEFTGDRCQNYVMASFY

SEQ ID NO: 152 - protein, 50 aa, Bos taurus
KCAEKEKTFCVNGGECFMVKDLSNPSRYLCKCQPGFTGARCTENVPMKVQ

SEQ ID NO: 153 - protein, 46 aa, Homo sapiens
ECLRKYKDFCIHGECKYVKELRAPSCKCQQEYFGERCGEKSNKTHS

SEQ ID NO: 154 - DNA, 198 bp, Homo sapiens
  CDS (1)...(195)
agccatcttgtcaagtgtgcagagaaggagaaaactttctgtgtgaatggaggcgagtgcttcatggtgaaagacctttcaaatccctcaagatacttgtgcaagtgcccaaatgagtttactggtgatcgctgccaaaactacgtaatggccagcttctacagtacgtccactccctttctgtctctgcctgaatag

SEQ ID NO: 155 - DNA, 192 bp, Homo sapiens
  CDS (1)...(189)
agccatcttgtcaagtgtgcagagaaggagaaaactttctgtgtgaatggaggcgagtgcttcatggtgaaagacctttcaaatccctcaagatacttgtgcaagtgccaacctggattcactggagcgagatgtactgagaatgtgcccatgaaagtccaaacccaagaaaaagcggaggagctctactaa

SEQ ID NO: 156 - DNA, 183 bp, Homo sapiens
  CDS (1)...(180)
agccatcttgtcaagtgtgcagagaaggagaaaactttctgtgtgaatggaggcgagtgcttcatggtgaaagacctttcaaatccctcaagatacttgtgcaagtgcccaaatgagtttactggtgatcgctgccaaaactacgtaatggccagcttctacaaagcggaggagctctactaa

SEQ ID NO: 157 - DNA, 210 bp, Homo sapiens
  CDS (1)...(207)
agccatcttgtcaagtgtgcagagaaggagaaaactttctgtgtgaatggaggcgagtgcttcatggtgaaagacctttcaaatccctcaagatacttgtgcaagtgcccaaatgagtttactggtgatcgctgccaaaactacgtaatggccagcttctacaagcatcttgggattgaatttatggagaaagcggaggagctctactaa

SEQ ID NO: 158 - DNA, 267 bp, Homo sapiens
  CDS (1)...(264)
agccatcttgtcaagtgtgcagagaaggagaaaactttctgtgtgaatggaggcgagtgcttcatggtgaaagacctttcaaatccctcaagatacttgtgcaagtgccaacctggattcactggagcgagatgtactgagaatgtgcccatgaaagtccaaacccaagaaaagtgcccaaatgagtttactggtgatcgctgccaaaactacgtaatggccagcttctacagtacgtccactccctttctgtctctgcctgaatag

SEQ ID NO: 159 - DNA, 252 bp, Homo sapiens
  CDS (1)...(249)
agccatcttgtcaagtgtgcagagaaggagaaaactttctgtgtgaatggaggcgagtgcttcatggtgaaagacctttcaaatccctcaagatacttgtgcaagtgccaacctggattcactggagcgagatgtactgagaatgtgcccatgaaagtccaaacccaagaaaagtgcccaaatgagtttactggtgatcgctgccaaaactacgtaatggccagcttctacaaagcggaggagctctactaa

SEQ ID NO: 160 - DNA, 128 bp, Bos taurus
  CDS (3)...(125)
ccacatccacatctacagctgggacaagccatcttgtcaagtgtgcagagaaggagaaaactttctgtgtgaatggaggcgagtgcttcatggtgaaagacctttcaaatccctcaagatacttgtgc

SEQ ID NO: 161 - DNA, 141 bp, Bos taurus
  CDS (2)...(139)
acataaccttatagctgagctaaggagaaacaaggcccacagatccaaatgcatgcagatccagctttccgcaactcatcttagagcttcttccattccccattgggcttcattctctaagaccccttggcctttaggaag

SEQ ID NO: 162 - protein, 24 aa, Homo sapiens
  VARIANT (15)...(22): Xaa in positions 15 and 22 is unknown.
AAEKEKTFCVNGGEXFMVKDLXNP

SEQ ID NO: 163 - DNA, 745 bp, Homo sapiens
  CDS (1)...(744)
atgagatggcgacgcgccccgcgccgctccgggcgtcccggcccccgggcccagcgccccggctccgccgcccgctcgtcgccgccgctgccgctgctgccactactgctgctgctggggaccgcggccctggcgccgggggcggcggccggcaacgaggcggctcccgcgggggcctcggtgtgctactcgtccccgcccagcgtgggatcggtgcaggagctagctcagcgcgccgcggtggtgatcgagggaaaggtgcacccgcagcggcggcagcagggggcactcgacaggaaggcggcggcggcggcgggcgaggcaggggcgtggggcggcgatcgcgagccgccagccgcgggcccacgggcgctggggccgcccgccgaggagccgctgctcgccgccaacgggaccgtgccctcttggcccaccgccccggtgcccagcgccggcgagcccggggaggaggcgccctatctggtgaaggtgcaccaggtgtgggcggtgaaagccgggggcttgaagaaggactcgctgctcaccgtgcgcctggggacctggggccaccccgccttcccctcctgcgggaggctcaaggaggacagcaggtacatcttcttcatggagcccgacgccaacagcaccagccgcgcgccggccgccttccgagcctctttcccccctctggagacgggccggaacctcaagaaggaggtcagccgggtgctgtgcaagcggtgcg

SEQ ID NO: 164 - protein, 12 aa, Bos taurus
  VARIANT (1)...(1): Xaa in position 1 is Lys or Arg.
XALAAAGYDVEK

SEQ ID NO: 165 - protein, 5 aa, Bos taurus
  VARIANT (1)...(1): Xaa in position 1 is Lys or Arg.
XLVLR

SEQ ID NO: 166 - protein, 11 aa, Bos taurus
  VARIANT (1)...(3): Xaa in position 1 is Lys or Arg; Xaa in positions 2 and 3 is unknown.
XXXYPGQITSN

SEQ ID NO: 167 - DNA, 60 bp, Homo sapiens
  variation (25)...(36): N in positions 25 and 31 is unknown.
atagggaagggcgggggaagggtcnccctcngcagggccgggcttgcctctggagcctct

SEQ ID NO: 168 - DNA, 18 bp, Homo sapiens
  variation (16)...(16): N in position 16 is unknown.
tttacacatatattcncc

SEQ ID NO: 169 - protein, 21 aa, Bos taurus
ETQPDPGQILKKVPMVIGAYT

SEQ ID NO: 170 - protein, 422 aa, Homo sapiens
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPQLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCPNEFTGDRCQNYVMASFYSTSTPFLSLPE

SEQ ID NO: 171 - protein, 69 aa, Homo sapiens
MSERKEGRGKGKGKKKERGSGKKPESAAGSQSPREIITGMPASTEGAYVSSESPIRISVSTEGANTSSS

SEQ ID NO: 172 - protein, 19 aa, Bos taurus
RKGDVPGPRVKSSRSTTTA

SEQ ID NO: 173 - DNA, 231 bp, Homo sapiens
  CDS (132)...(231)
cgcgagcgcctcagcgcggccgctcgctctccccctcgagggacaaacttttcccaaacccgatccgagcccttggaccaaactcgcctgcgccgagagccgtccgcgtagagcgctccgtctccggcgagatgtccgagcgcaaagaaggcagaggcaaagggaagggcaagaagaaggagcgaggctccggcaagaagccggagtccgcggcgggcagccagagcccag

SEQ ID NO: 174 - DNA, 178 bp, Homo sapiens
  CDS (3)...(178)
ccttgcctccccgattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagg

SEQ ID NO: 175 - DNA, 122 bp, Homo sapiens
  CDS (2)...(122)
gaagtcagaacttcgcattaacaaagcatcactggctgattctggagagtatatgtgcaaagtgatcagcaaattaggaaatgacagtgcctctgccaatatcaccatcgtggaatcaaacg

SEQ ID NO: 176 - DNA, 103 bp, Homo sapiens
  CDS (1)...(60)
gagatcatcactggtatgccagcctcaactgaaggagcatatgtgtcttcagagtctcccattagaatatcagtatccacagaaggagcaaatacttcttcat

SEQ ID NO: 177 - DNA, 128 bp, Homo sapiens
  CDS (3)...(128)
ctacatctacatccaccactgggacaagccatcttgtaaaatgtgcggagaaggagaaaactttctgtgtgaatggaggggagtgcttcatggtgaaagacctttcaaacccctcgagatacttgtgc

SEQ ID NO: 178 - DNA, 69 bp, Homo sapiens
  CDS (1)...(69)
aagtgccaacctggattcactggagcaagatgtactgagaatgtgcccatgaaagtccaaaaccaagaa

SEQ ID NO: 179 - DNA, 23 bp, Bos taurus
tcgggctccatgaagaagatgta

SEQ ID NO: 180 - DNA, 23 bp, Bos taurus
tccatgaagaagatgtacctgct

SEQ ID NO: 181 - DNA, 22 bp, Bos taurus
atgtacctgctgtcctccttga

SEQ ID NO: 182 - DNA, 22 bp, Bos taurus
ttgaagaaggactcgctgctca

SEQ ID NO: 183 - DNA, 20 bp, Bos taurus
aaagccgggggcttgaagaa

SEQ ID NO: 184 - DNA, 20 bp, Bos taurus
atgargtgtgggcggcgaaa

SEQ ID NO: 185 - protein, 477 aa, Homo sapiens
KCQPGFTGARCTENVPMKVQNQEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 186 - protein, 213 aa, Homo sapiens
  VARIANT (213)...(213): Xaa is Arg or absent.
KCQPGFTGARCTENVPMKVQNQEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 187 - protein, 430 aa, Homo sapiens
KCQPGFTGARCTENVPMKVQNQEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 188 - protein, 34 aa, Homo sapiens
KCQPGFTGARCTENVPMKVQNQESTSTPFLSLPE

SEQ ID NO: 189 - protein, 427 aa, Homo sapiens
KCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 190 - protein, 474 aa, Homo sapiens
KCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 191 - protein, 210 aa, Homo sapiens
  VARIANT (210)...(210): Xaa is Arg or absent.
KCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 192 - protein, 31 aa, Homo sapiens
KCPNEFTGDRCQNYVMASFYSTSTPFLSLPE

SEQ ID NO: 193 - protein, 497 aa, Homo sapiens
KCQPGFTGARCTENVPMKVQNQEKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 194 - protein, 233 aa, Homo sapiens
  VARIANT (233)...(233): Xaa is Arg or absent.
KCQPGFTGARCTENVPMKVQNQEKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 195 - protein, 450 aa, Homo sapiens
KCQPGFTGARCTENVPMKVQNQEKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 196 - protein, 54 aa, Homo sapiens
KCQPGFTGARCTENVPMKVQNQEKCPNEFTGDRCQNYVMASFYSTSTPFLSLPE

SEQ ID NO: 197 - protein, 222 aa, Homo sapiens
  VARIANT (222)...(222): Xaa is Arg or absent.
KCQPGFTGARCTENVPMKVQNQEKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 198 - protein, 439 aa, Homo sapiens
KCQPGFTGARCTENVPMKVQNQEKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 199 - protein, 486 aa, Homo sapiens
KCQPGFTGARCTENVPMKVQNQEKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 200 - protein, 219 aa, Homo sapiens
KCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 201 - protein, 436 aa, Homo sapiens
  VARIANT (219)...(219): Xaa is Arg or absent.
KCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 202 - protein, 483 aa, Homo sapiens
KCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 203 - protein, 242 aa, Homo sapiens
  VARIANT (242)...(242): Xaa is Arg or absent.
KCQPGFTGARCTENVPMKVQNQEKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 204 - protein, 459 aa, Homo sapiens
KCQPGFTGARCTENVPMKVQNQEKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 205 - protein, 506 aa, Homo sapiens
KCQPGFTGARCTENVPMKVQNQEKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 206 - protein, 33 aa, Homo sapiens
MSERKEGRGKGKGKKKERGSGKKPESAAGSQSP

SEQ ID NO: 207 - protein, 248 aa, Homo sapiens
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRC

SEQ ID NO: 208 - protein, 58 aa, Homo sapiens
LPPRLKEMKSQESAAGSKLVLRCETSSEYSSLRFKWFKNGNELNRKNKPQNIKIQKKP

SEQ ID NO: 209 - protein, 40 aa, Homo sapiens
KSELRINKASLADSGEYMCKVISKLGNDSASANITIVESN

SEQ ID NO: 210 - protein, 33 aa, Homo sapiens
IITGMPASTEGAYVSSESPIRISVSTEGANTSS

SEQ ID NO: 211 - protein, 42 aa, Homo sapiens
TSTSTTGTSHLVKCAEKEKTFCVNGGECFMVKDLSNPSRYLC

SEQ ID NO: 212 - protein, 653 aa, Homo sapiens
LPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 213 - protein, 389 aa, Homo sapiens
  VARIANT (389)...(389): Xaa is Arg or absent.
LPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 214 - protein, 606 aa, Homo sapiens
LPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 215 - protein, 210 aa, Homo sapiens
LPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQESTSTPFLSLPE

SEQ ID NO: 216 - protein, 603 aa, Homo sapiens
LPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 217 - protein, 650 aa, Homo sapiens
LPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 218 - protein, 386 aa, Homo sapiens
  VARIANT (386)...(386): Xaa is Arg or absent.
LPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 219 - protein, 207 aa, Homo sapiens
LPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYSTSTPFLSLPE

SEQ ID NO: 220 - protein, 673 aa, Homo sapiens
LPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 221 - protein, 409 aa, Homo sapiens
  VARIANT (409)...(409): Xaa is Arg or absent.
LPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 222 - protein, 626 aa, Homo sapiens
LPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 223 - protein, 230 aa, Homo sapiens
LPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKCPNEFTGDRCQNYVMASFYSTSTPFLSLPE

SEQ ID NO: 224 - protein, 398 aa, Homo sapiens
LPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 225 - protein, 615 aa, Homo sapiens
LPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 226 - protein, 662 aa, Homo sapiens
LPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 227 - protein, 395 aa, Homo sapiens
  VARIANT (395)...(395): Xaa is Arg or absent.
LPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 228 - protein, 612 aa, Homo sapiens
LPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 229 - protein, 659 aa, Homo sapiens
LPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 230 - protein, 418 aa, Homo sapiens
  VARIANT (417)...(417): Xaa is Arg or absent.
LPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 231 - protein, 635 aa, Homo sapiens
LPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 232 - protein, 682 aa, Homo sapiens
LPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 233 - protein, 619 aa, Homo sapiens
LPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 234 - protein, 355 aa, Homo sapiens
  VARIANT (355)...(355): Xaa is Arg or absent.
LPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 235 - protein, 572 aa, Homo sapiens
LPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 236 - protein, 176 aa, Homo sapiens
LPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQESTSTPFLSLPE

SEQ ID NO: 237 - protein, 569 aa, Homo sapiens
LPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 238 - protein, 616 aa, Homo sapiens
LPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 239 - protein, 352 aa, Homo sapiens
LPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 240 - protein, 173 aa, Homo sapiens
LPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCPNEFTGDRCQNYVMASFYSTSTPFLSLPE

SEQ ID NO: 241 - protein, 639 aa, Homo sapiens
LPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 242 - protein, 375 aa, Homo sapiens
LPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 243 - protein, 592 aa, Homo sapiens
  VARIANT (375)...(375): Xaa is Arg or absent.
LPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 244 - protein, 196 aa, Homo sapiens
LPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKCPNEFTGDRCQNYVMASFYSTSTPFLSLPE

SEQ ID NO: 245 - protein, 364 aa, Homo sapiens
  VARIANT (364)...(364): Xaa is Arg or absent.
LPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 246 - protein, 581 aa, Homo sapiens
LPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 247 - protein, 628 aa, Homo sapiens
LPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 248 - protein, 361 aa, Homo sapiens
  VARIANT (361)...(361): Xaa is Arg or absent.
LPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 249 - protein, 578 aa, Homo sapiens
LPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 250 - protein, 625 aa, Homo sapiens
LPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 251 - protein, 384 aa, Homo sapiens
  VARIANT (384)...(384): Xaa is Arg or absent.
LPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 252 - protein, 601 aa, Homo sapiens
LPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 253 - protein, 648 aa, Homo sapiens
LPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 254 - protein, 687 aa, Homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 255 - protein, 423 aa, Homo sapiens
  VARIANT (423)...(423): Xaa is Arg or absent.
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 256 - protein, 640 aa, Homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 257 - protein, 244 aa, Homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQESTSTPFLSLPE

SEQ ID NO: 258 - protein, 637 aa, Homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 259 - protein, 684 aa, Homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 260 - protein, 420 aa, Homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 261 - protein, 241 aa, Homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYSTSTPFLSLPE

SEQ ID NO: 262 - protein, 707 aa, Homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 263 - protein, 443 aa, Homo sapiens
  VARIANT (443)...(443): Xaa is Arg or absent.
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 264 - protein, 660 aa, Homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 265 - protein, 264 aa, Homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKCPNEFTGDRCQNYVMASFYSTSTPFLSLPE

SEQ ID NO: 266 - protein, 432 aa, Homo sapiens
  VARIANT (432)...(432): Xaa is Arg or absent.
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 267 - protein, 649 aa, Homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 268 - protein, 696 aa, Homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 269 - protein, 429 aa, Homo sapiens
  VARIANT (429)...(429): Xaa is Arg or absent.
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 270 - protein, 646 aa, Homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 271 - protein, 693 aa, Homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 272 - protein, 452 aa, Homo sapiens
  VARIANT (452)...(452): Xaa is Arg or absent.
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 273 - protein, 669 aa, Homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 274 - protein, 716 aa, Homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 275 - protein, 653 aa, Homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 276 - protein, 389 aa, Homo sapiens
  VARIANT (389)...(389): Xaa is Arg or absent.
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 277 - protein, 606 aa, Homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 278 - protein, 210 aa, Homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQESTSTPFLSLPE

SEQ ID NO: 279 - protein, 603 aa, Homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 280 - protein, 650 aa, Homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 281 - protein, 386 aa, Homo sapiens
  VARIANT (386)...(386): Xaa is Arg or absent.
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 282 - protein, 207 aa, Homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCPNEFTGDRCQNYVMASFYSTSTPFLSLPE

SEQ ID NO: 283 - protein, 673 aa, Homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 284 - protein, 409 aa, Homo sapiens
  VARIANT (409)...(409): Xaa is Arg or absent.
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 285 - protein, 626 aa, Homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 286 - protein, 230 aa, Homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKCPNEFTGDRCQNYVMASFYSTSTPFLSLPE

SEQ ID NO: 287 - protein, 398 aa, Homo sapiens
  VARIANT (398)...(398): Xaa is Arg or absent.
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 288 - protein, 615 aa, Homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 289 - protein, 662 aa, Homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 290 - protein, 395 aa, Homo sapiens
  VARIANT (395)...(395): Xaa is Arg or absent.
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 291 - protein, 612 aa, Homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 292 - protein, 659 aa, Homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 293 - protein, 418 aa, Homo sapiens
  VARIANT (418)...(418): Xaa is Arg or absent.
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 294 - protein, 635 aa, Homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 295 - protein, 682 aa, Homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 296 - protein, 902 aa, Homo sapiens
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 297 - protein, 638 aa, Homo sapiens
  VARIANT (638)...(638): Xaa is Arg or absent.
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 298 - protein, 855 aa, Homo sapiens
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 299 - protein, 459 aa, Homo sapiens
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQESTSTPFLSLPE

SEQ ID NO: 300 - protein, 852 aa, Homo sapiens
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 301 - protein, 899 aa, Homo sapiens
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 302 - protein, 635 aa, Homo sapiens
  VARIANT (635)...(635): Xaa is Arg or absent.
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 303 - protein, 456 aa, Homo sapiens
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYSTSTPFLSLPE

SEQ ID NO: 304 - protein, 922 aa, Homo sapiens
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 305 - protein, 658 aa, Homo sapiens
  VARIANT (658)...(658): Xaa is Arg or absent.
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 306 - protein, 875 aa, Homo sapiens
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 307 - protein, 479 aa, Homo sapiens
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKCPNEFTGDRCQNYVMASFYSTSTPFLSLPE

SEQ ID NO: 308 - protein, 647 aa, Homo sapiens
  VARIANT (647)...(647): Xaa is Arg or absent.
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 309 - protein, 864 aa, Homo sapiens
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 310 - protein, 911 aa, Homo sapiens
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 311 - protein, 644 aa, Homo sapiens
  VARIANT (644)...(644): Xaa is Arg or absent.
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 312 - protein, 861 aa, Homo sapiens
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 313 - protein, 908 aa, Homo sapiens
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 314 - protein, 667 aa, Homo sapiens
  VARIANT (667)...(667): Xaa is Arg or absent.
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 315 - protein, 884 aa, Homo sapiens
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 316 - protein, 931 aa, Homo sapiens
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 317 - protein, 868 aa, Homo sapiens
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 318 - protein, 604 aa, Homo sapiens
  VARIANT (604)...(604): Xaa is Arg or absent.
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 319 - protein, 821 aa, Homo sapiens
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 320 - protein, 425 aa, Homo sapiens
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQESTSTPFLSLPE

SEQ ID NO: 321 - protein, 818 aa, Homo sapiens
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 322 - protein, 865 aa, Homo sapiens
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 323 - protein, 601 aa, Homo sapiens
  VARIANT (601)...(601): Xaa is Arg or absent.
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 324 - protein, 422 aa, Homo sapiens
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCPNEFTGDRCQNYVMASFYSTSTPFLSLPE

SEQ ID NO: 325 - protein, 888 aa, Homo sapiens
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 326 - protein, 624 aa, Homo sapiens
  VARIANT (624)...(624): Xaa is Arg or absent.
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 327 - protein, 841 aa, Homo sapiens
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 328 - protein, 445 aa, Homo sapiens
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKCPNEFTGDRCQNYVMASFYSTSTPFLSLPE

SEQ ID NO: 329 - protein, 613 aa, Homo sapiens
  VARIANT (613)...(613): Xaa is Arg or absent.
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 330 - protein, 830 aa, Homo sapiens
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 331 - protein, 877 aa, Homo sapiens
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 332 - protein, 610 aa, Homo sapiens
  VARIANT (610)...(610): Xaa is Arg or absent.
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 333 - protein, 827 aa, Homo sapiens
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 334 - protein, 874 aa, Homo sapiens
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 335 - protein, 633 aa, Homo sapiens
  VARIANT (633)...(633): Xaa is Arg or absent.
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 336 - protein, 850 aa, Homo sapiens
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 337 - protein, 897 aa, Homo sapiens
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 338 - protein, 936 aa, Homo sapiens
  VARIANT (34)...(34): Xaa is any amino acid.
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 339 - protein, 672 aa, Homo sapiens
  VARIANT (34)...(34): Xaa is any amino acid
  VARIANT (672)...(672): Xaa is Arg or absent.
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 340 - protein, 889 aa, Homo sapiens
  VARIANT (34)...(34): Xaa is any amino acid
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 341 - protein, 493 aa, Homo sapiens
  VARIANT (34)...(34): Xaa is any amino acid
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQESTSTPFLSLPE

SEQ ID NO: 342 - protein, 886 aa, Homo sapiens
  VARIANT (34)...(34): Xaa is any amino acid
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 343 - protein, 933 aa, Homo sapiens
  VARIANT (34)...(34): Xaa is any amino acid
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 344 - protein, 669 aa, Homo sapiens
  VARIANT (34)...(34): Xaa is any amino acid
  VARIANT (669)...(669): Xaa is Arg or absent.
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 345 - protein, 490 aa, Homo sapiens
  VARIANT (34)...(34): Xaa is any amino acid
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYSTSTPFLSLPE

SEQ ID NO: 346 - protein, 956 aa, Homo sapiens
  VARIANT (34)...(34): Xaa is any amino acid
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 347 - protein, 692 aa, Homo sapiens
  VARIANT (34)...(34): Xaa is any amino acid
  VARIANT (692)...(692): Xaa is Arg or absent.
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 348 - protein, 909 aa, Homo sapiens
  VARIANT (34)...(34): Xaa is any amino acid
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 349 - protein, 513 aa, Homo sapiens
  VARIANT (34)...(34): Xaa is any amino acid
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKCPNEFTGDRCQNYVMASFYSTSTPFLSLPE

SEQ ID NO: 350 - protein, 681 aa, Homo sapiens
  VARIANT (34)...(34): Xaa is any amino acid
  VARIANT (681)...(681): Xaa is Arg or absent.
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 351 - protein, 898 aa, Homo sapiens
  VARIANT (34)...(34): Xaa is any amino acid
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 352 - protein, 945 aa, Homo sapiens
  VARIANT (34)...(34): Xaa is any amino acid
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 353 - protein, 678 aa, Homo sapiens
  VARIANT (34)...(34): Xaa is any amino acid
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 354 - protein, 895 aa, Homo sapiens
  VARIANT (34)...(34): Xaa is any amino acid
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 355 - protein, 942 aa, Homo sapiens
  VARIANT (34)...(34): Xaa is any amino acid
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 356 - protein, 701 aa, Homo sapiens
  VARIANT (34)...(34): Xaa is any amino acid
  VARIANT (701)...(701): Xaa is Arg or absent.
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 357 - protein, 918 aa, Homo sapiens
  VARIANT (34)...(34): Xaa is any amino acid
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 358 - protein, 965 aa, Homo sapiens
  VARIANT (34)...(34): Xaa is any amino acid
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 359 - protein, 902 aa, Homo sapiens
  VARIANT (34)...(34): Xaa is any amino acid
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 360 - protein, 638 aa, Homo sapiens
  VARIANT (34)...(34): Xaa is any amino acid
  VARIANT (638)...(638): Xaa is Arg or absent.
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 361 - protein, 855 aa, Homo sapiens
  VARIANT (34)...(34): Xaa is any amino acid
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 362 - protein, 459 aa, Homo sapiens
  VARIANT (34)...(34): Xaa is any amino acid
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQESTSTPFLSLPE

SEQ ID NO: 363 - protein, 852 aa, Homo sapiens
  VARIANT (34)...(34): Xaa is any amino acid
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 364 - protein, 899 aa, Homo sapiens
  VARIANT (34)...(34): Xaa is any amino acid
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 365 - protein, 635 aa, Homo sapiens
  VARIANT (34)...(34): Xaa is any amino acid
  VARIANT (635)...(635): Xaa is Arg or absent.
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 366 - protein, 456 aa, Homo sapiens
  VARIANT (34)...(34): Xaa is any amino acid
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCPNEFTGDRCQNYVMASFYSTSTPFLSLPE

SEQ ID NO: 367 - protein, 922 aa, Homo sapiens
  VARIANT (34)...(34): Xaa is any amino acid
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 368 - protein, 658 aa, Homo sapiens
  VARIANT (34)...(34): Xaa is any amino acid
  VARIANT (368)...(368): Xaa is Arg or absent.
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 369 - protein, 875 aa, Homo sapiens
  VARIANT (34)...(34): Xaa is any amino acid
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 370 - protein, 479 aa, Homo sapiens
  VARIANT (34)...(34): Xaa is any amino acid
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKCPNEFTGDRCQNYVMASFYSTSTPFLSLPE

SEQ ID NO: 371 - protein, 647 aa, Homo sapiens
  VARIANT (647)...(647): Xaa is Arg or absent.
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 372 - protein, 864 aa, Homo sapiens
  VARIANT (34)...(34): Xaa is any amino acid
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 373 - protein, 911 aa, Homo sapiens
  VARIANT (34)...(34): Xaa is any amino acid
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 374 - protein, 644 aa, Homo sapiens
  VARIANT (34)...(34): Xaa is any amino acid
  VARIANT (644)...(644): Xaa is Arg or absent.
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 375 - protein, 861 aa, Homo sapiens
  VARIANT (34)...(34): Xaa is any amino acid
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 376 - protein, 908 aa, Homo sapiens
  VARIANT (34)...(34): Xaa is any amino acid
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 377 - protein, 667 aa, Homo sapiens
  VARIANT (34)...(34): Xaa is any amino acid
  VARIANT (657)...(657): Xaa is Arg or absent.
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 378 - protein, 884 aa, Homo sapiens
  VARIANT (34)...(34): Xaa is any amino acid
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 379 - protein, 931 aa, Homo sapiens
  VARIANT (34)...(34): Xaa is any amino acid
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 380 - protein, 133 aa, Homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESN

SEQ ID NO: 381 - protein, 156 aa, Homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRISKASLADSGEYMCKVISKLGNDSASANITIVESNGKRCLLRAISQSLRGVIKVCGHT

SEQ ID NO: 382 - protein, 382 aa, Homo sapiens
  VARIANT (34)...(34): Xaa is any amino acid
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESN

SEQ ID NO: 383 - protein, 206 aa, Bos taurus
HQVWAAKAGGLKKDSLLTVRLGAWGHPAFPSCGRLKEDSRYIFFMEPEANSSGGPGRLPSLLPPSRDGPEPQEGGQPGAVQRCALPPRLKEMKSQESVAGSKLVLRCETSSEYSSLKFKWFKNGSELSRKNKPENIKIQKRPGKSELRISKASLADSGEYMCKVISKLGNDSASANITIVESNGKRCLLRAISQSLRGVIKVCGHT

SEQ ID NO: 384 - protein, 405 aa, Homo sapiens
  VARIANT (34)...(34): Xaa is any amino acid
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRISKASLADSGEYMCKVISKLGNDSASANITIVESNGKRCLLRAISQSLRGVIKVCGHT

SEQ ID NO: 385 - protein, 263 aa, Bos taurus
HQVWAAKAGGLKKDSLLTVRLGAWGHPAFPSCGRLKEDSRYIFFMEPEAKSSGGPGRLPSLLPPSRDGPEPQEGGQPGAVQRCALPPRLKEMKSQESVAGSKLVLRCETSSEYSSLKFKWFKNGSELSRKNKGGNIKIQKRPGKSGLRISKASLADSGEYMCKVISKLGNDSASANITIVESNATSTSTAGTSHLVKSAEKEKTFCVNGGECFMVKDLSNPSRYLCKCQPGFTGARCTENVPMKVQTQESAQMSLLVIAAKTT

SEQ ID NO: 386 - protein, 280 aa, Bos taurus
HQVWAAKAGGLKKDSLLTVRLGAWGHPAFPSCGRLKEDSRYIFFMEPEANSSGGPGRLPSLLPPSRDGPEPQEGGQPGAVQRCALPPRLKEMKSQESVAGSKLVLRCETSSEYSSLKFKWFKNGSELSRKNKPENIKIQKRPGKSELRISKASLADSGEYMCKVISKLGNDSASANITIVESNATSTSTAGTSHLVKCAEKEKTFCVNGGECFMVKDLSNPSRYLCKCQPGFTGARCTENVPMKVQTQEKCPNEFTGDRCQNYVMASFYSTSTPFLSLPE

SEQ ID NO: 387 - protein, 257 aa, Bos taurus
HQVWAAKAGGLKKDSLLTVRLGAWGHPAFPSCGRLKEDSRYIFFMEPEANSSGGPGRLPSLLPPSRDGPEPQEGGQPGAVQRCALPPRLKEMKSQESVAGSKLVLRCETSSEYSSLKFKWFKNGSELSRKNKPENIKIQKRPGKSELRISKASLADSGEYMCKVISKLGNDSASANITIVESNATSTSTAGTSHLVKCAEKEKTFCVNGGECFMVKDLSNPSRYLCKCPNEFTGDRCQNYVMASFYSTSTPFLSLPE

SEQ ID NO: 388 - protein, 560 aa, Bos taurus
KSELRISKASLADSGEYMCKVISKLGNDSASANITIVESNATSTSTAGTSHLVKCAEKEKTFCVNGGDCFMVKDLSNPSRYLCKCQPGFTGARCTENVPMKVQTQEKAEELYQKRVLTITGICIALLVVGIMCVVVYCKTKKQRKKLHDRLRQSLRSERNTMMNVANGPHHPNPPPENVQLVNQYVSKNVISSEHIVEREAESSFSTSHYTSTAHHSTTVTQTPSHSWSNGHTESIISESHSVIVMSSVENSRHSSPTGGPRGRLNGLGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSTTVSMPSMAVSPFVEEERPLLLVTPPRLREKYDHHAQQFNSFHCNPAHESNSLPPSPLRIVEDEEYETTQEYEPAQEPVKKLTNSSRRAKRTKPNGHIAHRLEMDNNTGADSSNSESETEDERVGEDTPFLAIQNPLAASLEAAPAFRLVDSRTNPTGGFSPQEELQARLSGVIANQDPIAV

SEQ ID NO: 389 - protein, 241 aa, Bos taurus
MSERREGKGKGKGGKKDRGSGKKPVPAAGGPSPALPPRLKEMKMQESVAGSKLVLRCETSSEYSSLKFKWFKNGSELSRKNKPQNIKIQKRPGKSELRISKASLADSGEYMCKVISKLGNDSASANITIVESNEITTGMPASTETAYVSSESPIRISVSTEGTNTSSSTSTSTAGTSHLVKCAEKEKTFCVNGGECFMVKDLSNPSRYLCKCPNEFTGDRCQNYVMASFYSTSTPFLSLPE

SEQ ID NO: 390 - protein, 137 aa, Bos taurus
  VARIANT (14)...(135): Xaa in positions 14, 23, 90, 100, 126, and 135 is unknown.
NYRDCIFMIIIVLXNILKPLWSXSCRKSELRISKASLADSGESMCKVISKLGNDSASANIRIVESNGKRCLLRAISQSLRGVIKVCGHTXITQVSEISCXTNKNHERKTLCLKYLMGPPVKLFTPXGEIDLKYIXII

SEQ ID NO: 391 - protein, 34 aa, Bos taurus
MSERREGKGKGKGGKKDRGSGKKPVPAAGGPSPA

SEQ ID NO: 392 - protein, 83 aa, Bos taurus
HQVWAAKAGGLKKDSLLTVRLGAWGHPAFPSCGRLKEDSRYIFFMEPEANSSGGPGRLPSLLPPSRDGPEPQEGGQPGAVQRC

SEQ ID NO: 393 - protein, 59 aa, Bos taurus
LPPRLKEHKSQESVAGSKLVLRCETSSEYSSLKFKWFKNGSELSRKNKPGNIKIQKRPG

SEQ ID NO: 394 - protein, 41 aa, Bos taurus
KSELRISKASLADSGEYMCKVISKLGNDSASANITIVESNA

SEQ ID NO: 395 - protein, 35 aa, Bos taurus
EITTGMPASTETAYVSSESPIRISVSTEGTNTSSS

SEQ ID NO: 396 - protein, 42 aa, Bos taurus
TSTSTAGTSHLVKCAEKEKTFCVNGGECFMVKDLSNPSRYLC

SEQ ID NO: 397 - protein, 23 aa, Bos taurus
KCQPGFTGARCTENVPMKVQTQE

SEQ ID NO: 398 - protein, 190 aa, Bos taurus
KAEELYQKRVLTITGICIALLVVGIMCVVVYCKTKKQRKKLHDRLRQSLRSERNTMMNVANGPHHPNPPPENVQLVNQYVSKNVISSEHIVEREAESSFSTSHYTSTAHHSTTVTQTPSHSWSNGHTESIISESHSVIVMSSVENSRHSSPTGGPRGRLNGLGGPRECNSFLRHARETPDSYRDSPHSER

SEQ ID NO: 399 - protein, 217 aa, Bos taurus
YVSAMTTPARMSPVDFHTPSSPKSPPSEMSPPVSSTTVSMPSMAVSPFVEEERPLLLVTPPRLREKYDHHAQQFNSFHCNPAHESNSLPPSPLRIVEDEEYETTQEYEPAQEPVKKLTNSSRRAKRTKPNGHIAHRLEMDNNTGADSSNSESETEDERVGEDTPFLAIQNPLAASLEAAPAFRLVDSRTNPTGGFSPQEELQARLSGVIANQDPIAV

SEQ ID NO: 400 - protein, 63 aa, Bos taurus & Homo sapiens
KSELRISKASLADSGEYMCKVISKLGNDSASANITIVESNGKRCLLRAISQSLRGVIKVCGHT

SEQ ID NO: 401 - protein, 20 aa, Bos taurus & Homo sapiens
KCPNEFTGDRCQNYVMASFY

SEQ ID NO: 402 - protein, 11 aa, Bos taurus & Homo sapiens
STSTPFLSLPE

SEQ ID NO: 403 - protein, 33 aa, Homo sapiens; identical to SEQ ID NO: 206

SEQ ID NO: 404 - protein, 248 aa, Homo sapiens; identical to SEQ ID NO: 207

SEQ ID NO: 405 - protein, 59 aa, Homo sapiens
LPPRLKEMKSQESAAGSKLVLRCETSSEYSSLRFKWFKNGNELNRKNKPQNIKIQKKPG

SEQ ID NO: 406 - protein, 41 aa, Homo sapiens
KSELRINKASLADSGEYMCKVISKLGNDSASANITIVESNA

SEQ ID NO: 407 - protein, 35 aa, Homo sapiens
EIITGMPASTEGAYVSSESPIRISVSTEGTNTSSS

SEQ ID NO: 408 - protein, 42 aa, Homo sapiens; identical to SEQ ID NO: 211

SEQ ID NO: 409 - protein, 23 aa, Homo sapiens
KCQPGFTGARCTENVPMKVQNQE

SEQ ID NO: 410 - protein, 9 aa, Homo sapiens
KHLGIEFME

SEQ ID NO: 411 - protein, 190 aa, Homo sapiens
KAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSER

SEQ ID NO: 412 - protein, 47 aa, Bos taurus
HNLIAELRRNKAHRSKCMQIQLSATHLRASSIPHWASFSKTPWPLGR

SEQ ID NO: 413 - protein, 217 aa, Homo sapiens
YVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 414 - protein, 65 aa, Homo sapiens
SHLVKCAEKEKTFCVNGGECFMVKDLSNPSRYLCKCPNEFTGDRCQNYVMASFYSTSTPFLSLPE

SEQ ID NO: 415 - protein, 63 aa, Homo sapiens
SHLVKCAEKEKTFCVNGGECFMVKDLSNPSRYLCKCQPGFTGARCTENVPMKVQTQEKAEELY

SEQ ID NO: 416 - protein, 60 aa, Homo sapiens
SHLVKCAEKEKTFCVNGGECFMVKDLSNPSRYLCKCPNEFTGDRCQNYVMASFYKAEELY

SEQ ID NO: 417 - protein, 69 aa, Homo sapiens
SHLVKCAEKEKTFCVNGGECFMVKDLSNPSRYLCKCPNEFTGDRCQNYVMASFYKHLGIEFMEKAEELY

SEQ ID NO: 418 - protein, 88 aa, Homo sapiens
SHLVKCAEKEKTFCVNGGECFMVKDLSNPSRYLCKCQPGFTGARCTENVPMKVQTQEKCPNEFTGDRCQNYVMASFYSTSTPFLSLPE

SEQ ID NO: 419 - protein, 83 aa, Homo sapiens
SHLVKCAEKEKTFCVNGGECFMVKDLSNPSRYLCKCQPGFTGARCTENVPMKVQTQEKCPNEFTGDRCQNYVMASFYKAEELY

SEQ ID NO: 420 - DNA, 6 bp, Bos taurus & Homo sapiens
aataaa

What is claimed is:

1. A method of stimulating myogenesis of a muscle cell in a mammal in need thereof, said method comprising administering to said mammal an effective amount of a neuregulin polypeptide with $p185^{erbB2}$ protein binding activity.

2. A method of increasing the myotube formation, myotube survival, muscle cell mitogenesis, muscle cell differentiation, or muscle cell survival in a mammal, said method comprising administering to said mammal an effective amount of a neuregulin polypeptide, said polypeptide being a polypeptide with $p185^{erbB2}$ protein binding activity.

3. The method of claim 2 or 1, wherein said mammal is a human.

4. The method of claim 2, wherein said muscle cell is a myoblast.

5. The method of claim 2, wherein said muscle cell is a satellite cell.

6. The method of claim 2 wherein said muscle cell is in skeletal muscle.

7. The method of claim 2 wherein said muscle cell is in cardiac muscle.

8. The method of claim 2 wherein said muscle cell is in smooth muscle.

9. The method of claim 2, wherein said increasing results in increasing myotube formation in said mammal.

10. The method of claim 2, wherein said increasing results in increasing myotube survival in said mammal.

11. The method of claim 2, wherein said increasing results in increasing muscle cell mitogenesis in said mammal.

12. The method of claim 2, wherein said increasing results in increasing muscle cell differentiation in said mammal.

13. The method of claim 2, wherein said increasing results in increasing the muscle fibers present in said mammal.

14. The method of claim 2, wherein said increasing results in increasing muscle cell survival in said mammal.

15. The method of claim 2, wherein said increasing results in increasing muscle growth in said mammal.

16. The method of claim 2, wherein said increasing results in increasing muscle regeneration in said mammal.

17. The method of claim 2, wherein said increasing results in decreasing the atrophy of said muscle cells.

18. The method of claim 2, wherein said mammal has a condition which involves muscle damage.

19. The method of claim 2, wherein said muscle cell is in a patient with a skeletal muscle disease.

20. The method of claim 19, wherein said skeletal muscle disease is a myopathy.

21. The method of claim 19, wherein said skeletal muscle disease is a dystrophy.

22. The method of claim 21, wherein said dystrophy is Duchenne's muscular dystrophy.

23. The method of claim 21, wherein said dystrophy is Beckker's dystrophy.

24. The method of claim 19, wherein said skeletal muscle disease is a result of a neural condition.

25. The method of claim 19 wherein said skeletal muscle disease results from an injury.

26. The method of claim 25, wherein said injury is a nerve injury.

27. The method of claim 19, wherein said skeletal muscle disease is resulting from a neuropathy.

28. The method of claim 2, wherein said muscle cell is in a patient with a cardiac muscle disorder.

29. The method of claim 28, wherein said cardiac disorder is cardiomyopathy.

30. The method of claim 28, wherein said cardiac disorder is ischemic damage.

31. The method of claim 28, wherein said cardiac disorder is a degenerative congenital disease.

32. The method of claim 28, wherein said cardiac disorder is cardiac trauma.

33. The method of claim 2, wherein said muscle cell is in a patient with a smooth muscle disorder.

34. The method of claim 33, wherein said disorder is arterial sclerosis and said increasing is an increasing of the differentiation of said muscle cells.

35. The method of claim 33, wherein said disorder is a vascular lesion.

36. The method of claim 33, wherein said disorder is a congenital vascular disease.

37. The method of claim 36, wherein said congenital vascular disease involves muscular damage.

38. The method of claim 2, wherein said mammal is a patient suffering from a disease, said patient having a decreased amount of neurotrophic factor relative to an unaffected individual.

39. The method of claim 2 wherein said muscle cell is in a patient with myasthenia gravis.

40. The method of claim 2, wherein said method is for the prophylaxis or treatment of a mammal having or at risk for a condition involving decreased muscle mitogenesis, differentiation, or survival, and said method comprising administering to said mammal an effective amount of a neuregulin polypeptide with $p185^{erbB2}$ protein binding activity.

* * * * *